United States Patent
Goodwin et al.

(10) Patent No.: US 8,367,628 B2
(45) Date of Patent: *Feb. 5, 2013

(54) AMPHOTERIC LIPOSOME FORMULATION

(75) Inventors: Neal Clifford Goodwin, Plainwell, MI (US); Gerold Endert, Halle (DE); Natalie Herzog, Cottbus (DE); Yvonne Kerwitz, Penzberg (DE); Steffen Panzner, Halle (DE); Wendi Rodrigueza, Roslindale, MA (US)

(73) Assignees: ProNAi Therapeutics, Inc., Kalamazoo, MI (US); Novosom AG, Halle (DE)

( * ) Notice: Subject to any disclaimer, the term of this patent is extended or adjusted under 35 U.S.C. 154(b) by 602 days.

This patent is subject to a terminal disclaimer.

(21) Appl. No.: 12/085,893

(22) PCT Filed: Dec. 1, 2006

(86) PCT No.: PCT/US2006/045955
§ 371 (c)(1),
(2), (4) Date: Mar. 19, 2009

(87) PCT Pub. No.: WO2007/064857
PCT Pub. Date: Jun. 7, 2007

(65) Prior Publication Data
US 2009/0220584 A1 Sep. 3, 2009

Related U.S. Application Data

(60) Provisional application No. 60/741,192, filed on Dec. 1, 2005, provisional application No. 60/778,473, filed on Mar. 2, 2006.

(51) Int. Cl.
*C12N 15/11* (2006.01)
*C07H 21/02* (2006.01)
*C07H 21/04* (2006.01)
*C12Q 1/68* (2006.01)

(52) U.S. Cl. .................. 514/44 A; 536/23.1; 536/24.5; 435/6.1

(58) Field of Classification Search .................. None
See application file for complete search history.

(56) References Cited

U.S. PATENT DOCUMENTS

| | | | |
|---|---|---|---|
| 5,264,423 A | 11/1993 | Cohen et al. | |
| 5,286,717 A | 2/1994 | Cohen et al. | |
| 5,474,796 A | 12/1995 | Brennan et al. | |
| 5,518,885 A | 5/1996 | Raziuddin et al. | |
| 5,576,208 A | 11/1996 | Monia et al. | |
| 5,582,986 A | 12/1996 | Monia et al. | |
| 5,591,607 A | 1/1997 | Gryaznov et al. | |
| 5,705,188 A | 1/1998 | Junichi et al. | |
| 5,734,039 A | 3/1998 | Calabretta et al. | |
| 5,792,608 A | 8/1998 | Swaminathan | |
| 5,840,497 A | 11/1998 | Holliday | |
| 5,874,416 A | 2/1999 | Sheikhnejad | |
| 5,891,858 A | 4/1999 | Rubenstein | |
| 5,968,748 A | 10/1999 | Bennet et al. | |
| 6,177,274 B1 | 1/2001 | Park et al. | |
| 6,287,591 B1 | 9/2001 | Semple et al. | |
| 6,365,345 B1 | 4/2002 | Brysch et al. | |
| 6,440,743 B1 | 8/2002 | Kabanov et al. | |
| 6,977,244 B2 | 12/2005 | Tormo et al. | |
| 7,022,831 B1 | 4/2006 | Reed | |
| 7,371,404 B2 * | 5/2008 | Panzner et al. | 424/450 |
| 7,498,315 B2 | 3/2009 | Sheikhnejad et al. | |
| 7,524,827 B2 * | 4/2009 | Sheikhnejad et al. | 514/44 R |
| 7,780,983 B2 * | 8/2010 | Panzner et al. | 424/450 |
| 7,807,647 B2 * | 10/2010 | Sheikhnejad et al. | 514/44 R |
| 7,858,117 B2 * | 12/2010 | Panzner et al. | 424/450 |
| 2003/0012812 A1 | 1/2003 | Tormo et al. | |
| 2003/0157030 A1 | 8/2003 | Davis et al. | |
| 2003/0165887 A1 | 9/2003 | Reed | |
| 2003/0176376 A1 | 9/2003 | Klem | |
| 2003/0219474 A1 | 11/2003 | Tormo et al. | |
| 2004/0006036 A1 | 1/2004 | Hu et al. | |
| 2004/0037874 A1 * | 2/2004 | Hong et al. | 424/450 |
| 2004/0131666 A1 * | 7/2004 | Panzner et al. | 424/450 |
| 2004/0241651 A1 | 12/2004 | Olek et al. | |
| 2005/0176025 A1 | 8/2005 | McSwiggen et al. | |
| 2005/0181037 A1 | 8/2005 | Ahmad et al. | |
| 2005/0203042 A1 | 9/2005 | Frieden et al. | |
| 2005/0287667 A1 | 12/2005 | Sheikhneijad et al. | |
| 2006/0073596 A1 | 4/2006 | Sheikhnejad et al. | |
| 2006/0135455 A1 | 6/2006 | Sheikhnejad et al. | |
| 2006/0198828 A1 | 9/2006 | Sheikhnehjad et al. | |
| 2006/0216343 A1 * | 9/2006 | Panzner et al. | 424/450 |
| 2006/0229267 A1 | 10/2006 | Sheikhnejad et al. | |
| 2007/0104775 A1 * | 5/2007 | Panzner et al. | 424/450 |
| 2007/0213285 A1 | 9/2007 | Sheikhnejad et al. | |
| 2008/0089932 A1 * | 4/2008 | Panzner et al. | 424/450 |
| 2008/0152700 A1 | 6/2008 | Sheikhnejad et al. | |
| 2008/0306153 A1 * | 12/2008 | Panzner et al. | 514/558 |
| 2008/0311181 A1 * | 12/2008 | Endert et al. | 424/450 |
| 2009/0220584 A1 | 9/2009 | Goodwin et al. | |
| 2009/0324587 A1 | 12/2009 | Goodwin et al. | |
| 2010/0330154 A1 * | 12/2010 | Panzner et al. | 424/450 |
| 2011/0135710 A1 | 6/2011 | Sheikhnejad et al. | |

FOREIGN PATENT DOCUMENTS

AU 2002234643 6/2007
DE 10361917 7/2005

(Continued)

OTHER PUBLICATIONS

Hafez et al. Meth. Enz. 2004. 387:113-134.*

(Continued)

*Primary Examiner* — Doug Schultz
(74) *Attorney, Agent, or Firm* — Honigman Miller Schwartz and Cohn LLP; Jonathan P. O'Brien; Kelly T. Murphy

(57) ABSTRACT

The invention relates to compositions and methods to inhibit gene expression. In particular, the invention provides DNAi oligonucleotides sequestered by amphoteric liposomes for the treatment of cancer.

16 Claims, 8 Drawing Sheets

FOREIGN PATENT DOCUMENTS

| | | |
|---|---|---|
| WO | WO9309127 | 5/1993 |
| WO | WO9309788 | 5/1993 |
| WO | WO9417086 | 8/1994 |
| WO | WO9508350 | 3/1995 |
| WO | WO9618732 | 6/1996 |
| WO | WO9714440 | 4/1997 |
| WO | WO9814172 | 4/1998 |
| WO | WO0177384 | 10/2001 |
| WO | WO0194600 | 12/2001 |
| WO | WO0217852 | 3/2002 |
| WO | WO02092617 | 11/2002 |
| WO | WO03040182 | 5/2003 |
| WO | WO03070912 | 8/2003 |
| WO | WO03072591 | 9/2003 |
| WO | WO03073826 | 9/2003 |
| WO | WO2004035523 | 4/2004 |
| WO | WO2004046327 | 6/2004 |
| WO | WO2004050885 | 6/2004 |
| WO | WO2004056971 | 7/2004 |
| WO | WO2005061710 | 7/2005 |
| WO | WO2005067632 | 7/2005 |
| WO | WO2005118824 | 12/2005 |
| WO | WO2006048329 | 5/2006 |
| WO | WO2006053646 | 5/2006 |
| WO | WO2007014150 | 2/2007 |
| WO | WO2007031333 | 3/2007 |
| WO | WO2007064853 | 6/2007 |
| WO | WO2007064857 | 6/2007 |
| WO | WO2007064945 | 6/2007 |
| WO | WO2007065017 | 6/2007 |
| WO | WO2007149269 | 12/2007 |
| WO | WO2008103431 | 8/2008 |
| WO | WO2009051712 | 4/2009 |

OTHER PUBLICATIONS

Bocchetta, et al., "Epidemiology and Molecular Pathology at Crossroads to Establish Causation: Molecular Mechanisms of Malignant Transformation." Oncogene 23: 6484-6491, 2004.
Carbone, et al., "DNA binding and antigene activity of a daunomycin-conjugated triplex-forming oligonucleotide targeting the P2 promoter of the human c-myc gene." Nucleic Acids Research 32(8): 2396-2410, 2004.
Chirila, et al., "The use of synthetic polymers for deliver of therapeutic antisense oligodeoxynucleotides." Biomaterials 23: 321-342, 2002.
Christman, et al., "5-Methyl-2'-deoxycytidine in single-stranded DNA can act in cis to signal de novo DNA methylation." Proc. Natl. Acad. Sci. USA. 92:7347-7351, 1995.
Harel-Bellan, et al., Specific Inhibition of c-myc Protein Biosynthesis using an Antisense Synthetic Deoxy-Oligonucleotide in Human T Lymphocytes.: The Journal of Immunology 140: 2431-2435, 1988.
Heckman, et al., "A-Myb Up-regulates Bcl-2 through a Cdx Binding Site in t(14;18) Lymphoma Cells." The Journal of Biological Chemistry, 275(9): 6499-6508, 2000.
Hyung-Gyoon, et al., "Inhibition of Transcription of the Human c-myc Protooncogene by Intermolecular Triplex." Biochemistry 37: 2299-2304, 1998.
Jen, et al., "Suppression of Gene Expression by Targeted Disruption of Messenger RNA: Available Options and Current Strategies." Stem Cells 18: 307-319, 2000.
McGuffie, et al., "Antigene and Antiproliferative Effects of a c-myc-targeting Phosphorothioate Triplex Helix-forming Oligonucleotide in Human Leukemia Cells." Cancer Research 60: 3790-3799, 2000.
Mohammad, et al., "Bcl-2 Antisense Oligonucleotides are Effective against Systemic but not Central Nervous System Disease in Severe Combined Immunodeficient Mice Bearing Human t(14;18) Follicular Lymphoma." Clinical Cancer Research 8: 1277-1283, 2002.
Morris, et al., "Phase I Trial of BCL-2 Antisense Oligonucleotide (G3139) Administered by Continuous Intravenous Infusion in Patients with Advanced Cancer." Clinical Cancer Research 8:679-683, 2002.

Olivas, Wendy M. and Maher, L. James, III, "Binding of DNA oligonucleotides to sequences in the promoter of the human bcl-2 gene." Nucleic Acids Research 24(9): 1758-1764, 1996.
Opalinska, et al., "Nucleic-Acid Therapeutics: Basic Principles and Recent Applications." Nature Reviews Drug Discovery 1: 503-514, 2002.
Putnam, David., "Antisense Strategies and Therapeutic Applications." American Journal of Health-System Pharmacy 53(2): 151-160, 1996.
Shen, et al., "Triplex forming oligonucleotides targeted to 3'UTR downregulates the expression of the bcl-2 proto-oncogene in HeLa cells." Nucleic Acids Research 29(3): 622-628, 2001.
Shen, et al., "Targeting bcl-2 by Triplex-Forming Oligonucleotide—A Promising Carrier for Gene-Radiotherapy." Cancer Biotherapy & Radiopharmaceuticals 18(1): 17-26, 2003.
Tufarelli, et al., "Transcription of antisense RNA leading to gene silencing and methylation as a novel cause of human genetic disease." Nature Genetics 34(2): 157-165, 2003.
Warzocha, et al., "Antisense Strategy: Biological Utility and Prospects in the Treatment of Hematological Malignancies." Leukemia and Lymphoma, Harwood Academic Publishers, Chur. CH, 24(3/4): 267-281, Jan. 1997.
Xodo, et al., "Anti-gene strategies to down-regulate gene expression in mammalian cells." Current Pharmaceutical Design 10(7): 805-819, 2004.
Adachi, et al., "Potential zDNA elements surround the breakpoints of chromosome translocation within the 5' flanking region of bcl-2 gene." Oncogene 5(11): 1653-1657, 1990.
Alunni-Fabbroni, Marianna, et al., "(A,G)-Oligonucleotides Form Extraordinary Stable Triple Helices with a Critical R-Y Sequence of the Murine c-Ki-ras Promoter and Inhibit Transcription in Transfected NIH 3T3 Cells," Biochemistry, vol. 35, pp. 16361-16369 (1996).
Anderson, et al., "Targeted anti-cancer therapy using rituximab, a chimeric anti-CD20 antibody (IDEC-C2B8) in the treatment of non-Hodgkin's B-cell lymphoma." Biochemical Society Transactions. Colchester, Essex, GB. 2(25): 705-708, 1997, [presented at BST 660th meeting, Dec. 10-13, 1996. Harrogate, GB].
Bentley, et al., "Novel promoter upstream of the human c-myc gene and regulation of c-myc expression in B-cell lymphomas." Molecular and Cellular Biology 6(10): 3481-3489, 1986.
Braasch, et al., "Antisense inhibition of gene expression in cells by oligonucleotides incorporating locked nucleic acids: incorporating locked nucleic acids: Effect of mRNA target sequence and chimera design." Nucleic Acids Research 30(23): 5160-5167, 2002.
Chien, et al., "NeoPhectin™, a novel cationic cardioloipin liposomes for safe and enhanced transfection of cells." Experimental and Molecular Therapeautics 43: Gene Therapy III, Abstract #4606 in: Proc Amer Assoc Cancer Res vol. 45, 2004.
Choi, et al., "Low toxicity of cationic lipid-based emulsion for gene transfer." Biomaterials 25(27): 5893-5903, 2004.
Cogoi, Susanna, et al., "G-rich Oligonucleotide Inhibits the Binding of a Nuclear Protein to the Ki-ras Promoter and Strongly Reduces Cell Growth in Human Carcinoma Pancreatic Cells", Biochemistry, vol. 43, pp. 2512-2523 (2003).
Cogoi, Susanna, et al., "Antiproliferative activity of a triplex-forming oligonucleotide recognizing a Ki-ras polypurine/polypyrimidine motif correlates with protein binding", Cancer Gene Therapy, vol. 11, pp. 465-476 (2004).
Cogoi, Susanna, et al., "Anti-gene Effect in Live Cells of AG Motif Triplex-Forming Oligonucleotides Containing an Increasing Number of Phosphorothioate Linkages", Biochemistry, vol. 40, No. 5, pp. 1135-1143 (2001).
Cutrona, Giovanna, et al., "Inhibition of the Translocated c-myc in Burkitt's Lymphoma by a PNA Complementary to the Eu Enhancer", Cancer Research, vol. 63, pp. 6144-6148 (2003).
Ebbinghaus, Scot W., et al., "Triplex Formation Inhibits HER-2/neu Transcription in Vitro", J. Clin. Invest., vol. 92, pp. 2433-2439 (1993).
EMBL Database "*Homo sapiens* c-myc proto-oncogene regulatory region" retrieved from EBI accession No. EMBL: AJ315134, revised Jul. 24, 2001 (http://www.ebi.ac.uk/ena/data/view/AJ315134, viewed Jun. 16, 2011).

EMBL Database "Human bcl-2 gene 5'-flanking region" retrieved from EBI accession No. EMBL: X51898, submitted Feb. 16, 1990 (http://www.ebi.ac.uk/ena/data/view/X51898, viewed Jun. 16, 2011).

Gray, Gary D., et al., "Antisense DNA Inhibition of Tumor Growth Induced by c-Ha-ras Oncogene in Nude Mice", Cancer Research, vol. 53, pp. 577-580 (1993).

Hafez, et al., "Tunable pH-sensitive Liposomes." Methods in Enzymology, 387: 113-134, 2004.

Kim, et al., "Inhibition of in vitro transcription by a triplex-forming oligonucleotide targeted to human c-myc P2 promoter." Biochemistry 34(25): 8165-8171, 1995.

Kool, Eric T., "Circular Oligonucleotides: New Concepts in Oligonucleotide Design," Annual Reviews Biophys. Biomol. Struct., vol. 25, pp. 1-28 (1996).

Lasic "Recent developments in medical applications of liposomes: sterically stabilized liposomes in cancer therapy and gene delivery in vivo." Journal of Controlled Release 48(2-3): 203-222, 1997.

Mayfield, et al., "Effect of a basic linker substitution on triplex formation, Sp1 binding, and specificity in an oligonucleotide targeted to the human Ha-ras promoter", Nucleic Acids Research, vol. 22, No. 10, pp. 1909-1916 (1994).

Orum, "Engineering in genomics—RNA antagonists—a new class of antisense drugs." IEEE Engineering in Medicine and Biology 24(4): 81-87, 2005.

Porumb, Horea, et al, "Temporary ex Vivo Inhibition of the Expression of the Human Oncogene Her2 (NEU) by a Triple Helix-forming Oligonucleotide", Cancer Research, vol. 56, pp. 515-522 (1996).

Postel, et al., "Evidence that a triplex-forming oligodeoxyribonucleotide binds to the c-myc promoter in HeLa cells thereby reducing c-myc messenger RNA levels." Proceedings of the National Academy of Sciences (USA) 88(18): 8227-8231, 1991.

Reed, "Promise and problems of Bcl-2 antisense therapy." Journal of the National Cancer Institute 89(14): 988-990, 1997.

Simoes-Wüst, et al., "A functionally improved locked nucleic acid antisense oligonucleotide inhibits Bcl-2 and Bcl-xL expression and facilitates tumor cell apoptosis." Oligonucleotides 14(3): 199-209, 2004.

Williams, et al., "Effects of phosphodiester and phosphorothioate antisense oligodeoxynucleotides on cell lines which overexpress c-myc: Implications of the treatment of Burkitt's Lymphoma." Annals of Oncology 8 (sup 1): S25-S30, 1997.

Witters, Lois M., et al, "Enhanced anti-proliferative activity of the combination of tamoxifen plus HER-2-neu antibody", Breast Cancer Research and Treatment, vol. 42, pp. 1-5 (1997).

Young, et al., "Hybridization and disassociation rates of phosphodiester or modified oligodeoxynucleotides with RNA at near-physiological conditions." Nucl. Acids Res. 19:2463-2470, 1991.

Ziegler, et al., "Induction of apoptosis in small cell lung cancer cells by antisense oligodeoxynucleotide targeting the Bcl-2 coding sequence." Journal of the National Cancer Institute 89(14): 1027-1036, 1997.

ISR for PCT/US2005/018993 of Nov. 9, 2006.
ISR for PCT/US2006/045946 of Nov. 1, 2007.
ISR for PCT/US2006/045955 of Aug. 30, 2007.
ISR for PCT/US2006/046111 of Jul. 26, 2007.
ISR for PCT/US2006/046298 of Sep. 20, 2007.
ISR for PCT/US2008/011748 of Apr. 23, 2009.
ISR for PCT/US2008/002332 of Jun. 25, 2009.

Kim et al., Inhibition of Transcription of the Human c-myc Protooncogene by Intermolecular Triplex, Biochemistry, 37: 2299-2304, 1998.

Mayfield et al., Triplex Formation by the Human Ha-ras Promoter Inhibits Sp1 Binding and in Vitro Transcription, The Journal of Biological Chemistry, 269(27): 18232-18238, 1994.

* cited by examiner

AMPHOTERIC LIPOSOME FORMULATION

PRIORITY

This application is the U.S. National phase of International Application Number PCT/US2006/045955 filed on Dec. 1, 2006, which claims priority to U.S. Provisional patent application No. 60/741,192, filed on Dec. 1, 2005, and to U.S. Provisional application No. 60/778,473, filed on Mar. 2, 2006, all of which are herein incorporated by reference in their entireties.

JOINT RESEARCH AGREEMENT

The presently claimed invention was made by or on behalf of the below listed parties to a joint research agreement. The joint research agreement was in effect on or before the date the claimed invention was made and the claimed invention was made as a result of activities undertaken within the scope of the joint research agreement. The parties to the joint research agreement are ProNAi Therapeutics, Inc, and Novosom AG.

SEQUENCE LISTING

This application incorporates by reference in its entirety the sequence listing entitled "Amphoteric Liposome Formulation.txt" created Jun. 12, 2011 (700 kb) and filed electronically with the United States Patent and Trademark Office.

BRIEF DESCRIPTION OF THE INVENTION

The invention relates to compositions and methods of using the same to treat cancer. In particular, the invention relates to DNAi oligonucleotides sequestered with amphoteric liposomes for the treatment of cancer.

BACKGROUND

Oncogenes have become the central concept in understanding cancer biology and may provide valuable targets for therapeutic drugs. In many types of human tumors, including lymphomas and leukemias, the oncogenes are overexpressed, and may be associated with tumorigenicity (Tsujimoto et al., Science 228:1440-1443 (1985)). For instance, high levels of expression of the human bcl-2 gene have been found in all lymphomas with a t(14; 18) chromosomal translocations including most follicular B cell lymphomas and many large cell non-Hodgkin's lymphomas. High levels of bcl-2 gene expression have also been found in certain leukemias that do not have a t(14; 18) chromosomal translation, including most cases of chronic lymphocytic leukemia acute, many lymphocytic leukemias of the pre-B cell type, neuroblastomas, nasopharyngeal carcinomas, and many adenocarcinomas of the prostate, breast and colon. (Reed et al., Cancer Res. 51:6529 [1991]; Yunis et al., New England J. Med. 320:1047; Campos et al., Blood 81:3091-3096 [1993]; McDonnell et al., Cancer Res. 52:6940-6944 [1992]; Lu et al., Int. J. Cancer 53:29-35 [1993]; Bonner et al., Lab Invest. 68:43A [1993]. Other oncogenes include TGF-α, c-ki-ras, ras, Her-2, and c-myc.

The expression of oncogenes may be inhibited by single stranded DNAi oligonucleotides. Nucleic acid therapeutics, however, often lack therapeutic efficacy due to instability in body fluids or inefficient uptake into cells.

There is therefore a need for a stable and efficient delivery of such DNAi oligonucleotides in body fluids and cells for the treatment of cancer.

SUMMARY OF THE INVENTION

The invention provides compositions and methods for preparing and using amphoteric liposomes for the delivery of DNAi oligonucleotides for the treatment of cancer. Such amphoteric liposomes may, for example, have an anionic or neutral charge at physiological pH and a cationic charge at an acidic pH of about 4. Advantageously, the compositions of the present invention sequester high amounts of DNAi oligonucleotides, between about 1 to 4 mg/ml (e.g., about 2 mg/ml) at a lipid concentration of about 10 to 100 mM or less; exhibit colloidal and serum stability; enhanced uptake into cells and tumors due to average liposome sizes of less than 200 ηm; and low toxicity relative to liposomes formed with cationic lipids that are used in conventional transfection reagents.

In a first aspect, the invention provides a mixture comprising amphoteric liposomes and a DNAi oligonucleotide. In an embodiment of the first aspect, the amphoteric liposomes have an isoelectric point of between 4 and 8. In a further embodiment, the amphoteric liposomes are negatively charged or neutral at pH 7.4 and positively charged at pH 4.

In another embodiment of the first aspect, the amphoteric liposomes include amphoteric lipids. In a further embodiment, the amphoteric lipids can be HistChol, HistDG, iso-HistSucc DG, Acylcarnosine, HCChol or combinations thereof. In another embodiment, the amphoteric liposomes include a mixture of one or more cationic lipids and one or more anionic lipids. In yet another embodiment, the cationic lipids can be DMTAP, DPTAP, DOTAP, DC-Chol, MoChol or HisChol, or combinations thereof, and the anionic lipids can be CHEMS, DGSucc, Cet-P, DMGSucc, DOGSucc, POGSucc, DPGSucc, DG Succ, DMPS, DPPS, DOPS, POPS, DMPG, DPPG, DOPG, POPG, DMPA, DPPA, DOPA, POPA or combinations thereof.

In yet another embodiment, the liposomes also include neutral lipids. In a further embodiment, the neutral lipids include sterols and derivatives thereof. In an even further embodiment, the sterols comprise cholesterol and derivatives thereof. The neutral lipids may also include neutral phospholipids. In one embodiment, the phospholipids include phosphatidylcholines or phosphatidylcholines and phosphoethanolamines. In another embodiment, the phosphatidylcholines are POPC, OPPC, natural or hydrogenated soy bean PC, natural or hydrogenated egg PC, DMPC, DPPC or DOPC and derivatives thereof and the phosphatidylethanolamines are DOPE, DMPE, DPPE or derivatives and combinations thereof. In a further embodiment, the phosphatidylcholine is POPC, OPPC, soy bean PC or egg PC and the phosphatidylethanolamines is DOPE.

In an even further embodiment, the lipids of the amphoteric liposomes include DOPE, POPC, CHEMS and MoChol; POPC, Chol, CHEMS and DOTAP; POPC, Chol, Cet-P and MoChol, or POPC, DOPE, MoChol and DMGSucc.

In a second aspect, the amphoteric liposomes of the mixture of the invention can be formed from a lipid phase comprising a mixture of lipid components with amphoteric properties, wherein the total amount of charged lipids in the liposome can vary from 5 mole % to 70 mole %, the total amount of neutral lipids may vary from 20 mole % to 70 mole %, and a DNAi oligonucleotide. In an embodiment of the first aspect, the amphoteric liposomes include 3 to 20 mole % of POPC, 10 to 60 mole % of DOPE, 10 to 60 mole % of MoChol and 10 to 50 mole % of CHEMS. In a further embodiment, the liposomes include POPC, DOPE, MoChol and CHEMS in the molar ratios of POPC/DOPE/MoChol/CHEMS of about 6/24/47/23 or 15/45/20/20. In yet another embodiment, the liposomes include 3 to 20 mole % of POPC, 10 to 40 mole % of DOPE, 15 to 60 mole % of MoChol and 15 to 60 mole % of DMGSucc. In a further embodiment, the liposomes include POPC, DOPE, DMGSucc and MoChol in the molar ratios of POPC/DOPE/DMGSucc/MoChol of about 6/24/47/23 or 6/24/23/47. In still another embodiment, the liposomes include 10 to 50 mole % of POPC, 20 to 60 mole % of Chol, 10 to 40 mole % of CHEMS and 5 to 20 mole % of DOTAP. In a further embodiment, the liposomes include POPC, Chol, CHEMS and DOTAP in the molar ratio of POPC/Chol/CHEMS/DOTAP of about 30/40/20/10. In yet another embodiment the liposomes include 10 to 40 mole % of POPC, 20 to 50 mole % of Chol, 5 to 30 mole % of Cet-P and 10 to 40 mole % of MoChol. In a further embodiment, the molar ratio of POPC/Chol/Cet-P/MoChol is about 35/35/10/20.

In a third aspect, the DNAi oligonucleotide contained in the amphoteric liposomal mixture comprises a DNAi oligonucleotide that hybridizes to SEQ ID NO:1249 or portions thereof. In another embodiment, the DNAi oligonucleotide can be SEQ ID NO:1250, 1251, 1252, 1253, 1267-1447 or the complement thereof. In yet another embodiment the DNAi oligonucleotide can be SEQ ID NO:1250 or 1251 or the complement thereof.

The amphoteric liposomal mixture of this invention may further include an additional DNAi oligonucleotide, e.g., comprising one of SEQ ID NOs: 1250-1253 and 1270-1477, or selected from the group consisting of SEQ ID NOs: 2-281, 283-461, 463-935, 937-1080, 1082-1248 and the complements thereof.

In another embodiment, the DNAi oligonucleotides contained in the liposomal mixture are between 15 and 35 base pairs in length.

In a fourth aspect, the amphoteric liposome-DNAi oligonucleotide mixture includes the DNAi oligonucleotides SEQ ID NO:1250 or 1251 and amphoteric liposomes comprising POPC, DOPE, MoChol and CHEMS in the molar ratio of POPC/DOPE/MoChol/CHEMS of about 6/24/47/23.

In a fifth aspect, the amphoteric liposome-DNAi oligonucleotide mixture includes the DNAi oligonucleotide, PNT-100 (SEQ ID NO:1251), and amphoteric liposomes comprising POPC, DOPE, MoChol and CHEMS in the molar ratio of POPC/DOPE/MoChol/CHEMS of about 15/45/20/20.

In a sixth aspect, the amphoteric liposomes of the mixture can include a size between 50 and 500 ηm. In one embodiment, the size is between 80 and 300 ηm and in another embodiment the size is between 90 and 200 ηm.

In a seventh aspect, the amphoteric liposomes may have an isoelectric point between 4 and 8. In an embodiment of the sixth aspect, the amphoteric liposomes may be negatively charged or neutral at pH 7.4 and positively charged at pH 4.

In an eighth aspect, the amphoteric liposomes have a DNAi oligonucleotide concentration of at least about 2 mg/ml at a lipid concentration of 10 to 100 mM or less.

In a ninth aspect, the invention provides a method of preparing amphoteric liposomes containing a DNAi oligonucleotide. In one embodiment, the method includes using an active loading procedure and in another, a passive loading procedure. In a further embodiment, the method produces liposomes using manual extrusion, machine extrusion, homogenization, microfluidization or ethanol injection. In yet another embodiment, the method has an encapsulation efficiency of at least 35%.

In a tenth aspect, the invention provides a method of introducing the DNAi oligonucleotide-amphoteric liposome mixture to cells or an animal. In one embodiment, the method includes administering the mixture to mammal to treat cancer. The administered mixtures can reduce or stop tumor growth in mammals. In another embodiment, the introduction of the mixture results in a reduction of cell proliferation. In another embodiment, the mixture is administered to a cancer cell, a non-human animal or a human. In a further embodiment, the mixture is introduced to an animal at a dosage of between 0.01 mg to 100 mg per kg of body weight. In yet another embodiment, the mixture is introduced to the animal one or more times per day or continuously. In still another embodiment, the mixture is introduced to the animal via topical, pulmonary or parenteral administration or via a medical device. In an even further embodiment, the mixture administered to the animal or cells further includes a chemotherapy agent, and/or a cell targeting component.

Figure 1:
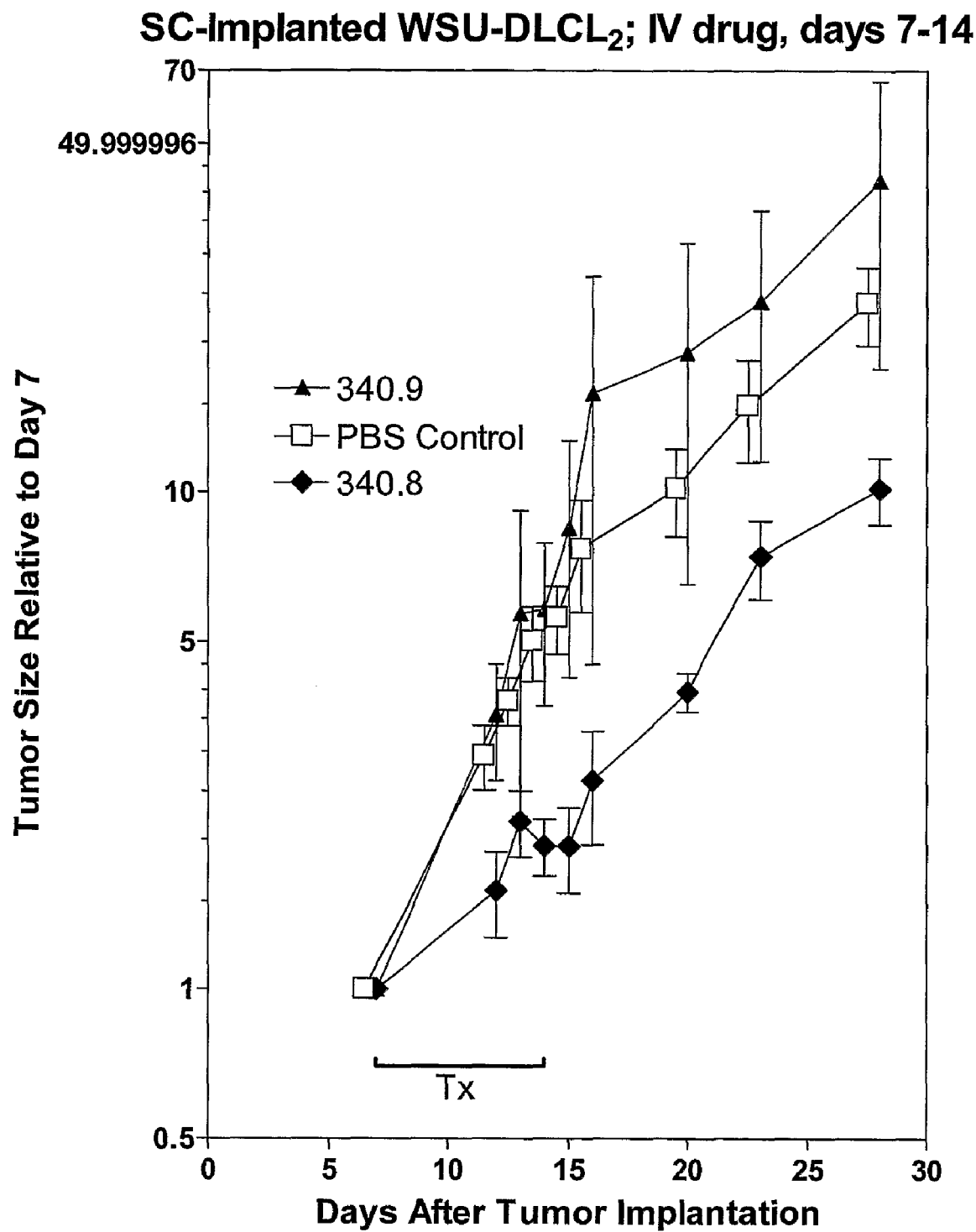
FIG. 1 shows the effect of SEQ ID NO:1251 sequestered in amphoteric liposomes on the size of tumors from non-Hodgkin's Lymphoma WSU-DLCL2 xenografts in SCID mice.

Other features and advantages of the invention will be apparent from the following detailed description, and from the claims.

BRIEF DESCRIPTION OF THE SEQUENCES

| | |
|---|---|
| SEQ ID NO: 1 | c-erb-2 (her-2) upstream region |
| SEQ ID NOs: 2-281 | c-erb-2 (her-2) DNAi oligonucleotides |
| SEQ ID NO: 282 | c-ki-ras upstream region |
| SEQ ID NOs: 283-461 | c-ki-ras DNAi oligonucleotides |
| SEQ ID NO: 462 | c-Ha-ras upstream region |
| SEQ ID NOs: 463-935 | c-Ha-ras DNAi oligonucleotides |
| SEQ ID NO: 936 | c-myc upstream region |
| SEQ ID NOs: 937-1080 | c-myc DNAi oligonucleotides |
| SEQ ID NO: 1081 | TGF-α upstream region |
| SEQ ID NOs: 1082-1248 | TGF-α DNAi oligonucleotides |

| | |
|---|---|
| SEQ ID NO: 1249 | bcl-2 upstream region |
| SEQ ID NO: 1250 | PNT-100 DNAi oligomer methylated |
| SEQ ID NO: 1251 | PNT-100 DNAi oligomer |
| SEQ ID NO: 1252 | DNAi oligomer methylated |
| SEQ ID NO: 1253 | DNAi oligomer |
| SEQ ID NO: 1255 | bcl-2 secondary promoter sequence |
| SEQ ID NOs: 1256-1266 | bcl-2 sequences |
| SEQ ID NOs: 1267-1477 and 1250-1254 | bcl-2 DNAi oligomers |

DETAILED DESCRIPTION

I. Definitions

To facilitate understanding of the invention, a number of terms are defined below.

As used herein, "amphoter" or "amphoteric" character refers to a structure, being a single substance (e.g., a compound) or a mixture of substances (e.g., a mixture of two or more compounds) or a supramolecular complex (e.g., a liposome) comprising charged groups of both anionic and cationic character wherein (i) at least one of the charged groups has a pK between 4 and 8, (ii) the cationic charge prevails at pH 4 and (iii) the anionic charge prevails at pH 8, resulting in an isoelectric point of neutral net charge between pH 4 and pH 8. Amphoteric character by that definition is different from zwitterionic character, as zwitterions do not have a pK in the range mentioned above. Consequently, zwitterions are essentially neutrally charged over a range of pH values. Phosphatidylcholine or phosphatidylethanolamines are neutral lipids with zwitterionic character.

As used herein, "Amphoter I Lipid Pairs" refers to lipid pairs containing a stable cation and a chargeable anion. Examples include without limitation DDAB/CHEMS, DOTAP/CHEMS and DOTAP/DOPS. In some aspects, the ratio of the percent of cationic lipids to anionic lipids is lower than 1.

As used herein, "Amphoter II Lipid Pairs" refers to lipid pairs containing a chargeable cation and a chargeable anion. Examples include without limitation Mo-Chol/CHEMS, DPIM/CHEMS or DPIM/DG-Succ. In some aspects, the ratio of the percent of cationic lipids to anionic lipids is between about 5 and 0.2.

As used herein, "Amphoter III Lipid Pairs" refers to lipid pairs containing a chargeable cation and stable anion. Examples include without limitation Mo-Chol/DOPG or Mo-Chol/Chol-SO$_4$. In one embodiment, the ratio of the percent of cationic lipids to anionic lipids is higher than 1.

As used herein, "liposome" refers to one or more lipids forming a complex, usually surrounded by an aqueous solution. Liposomes are generally spherical structures comprising lipids fatty acids, lipid bilayer type structures, unilamellar vesicles and amorphous lipid vesicles. Generally, liposomes are completely closed lipid bilayer membranes containing an entrapped aqueous volume. The liposomes may be unilamellar vesicles (possessing a single bilayer membrane), oligolamellar or multilamellar (an onion-like structure characterized by multiple membrane bilayers, each separated from the next by an aqueous layer). Liposomes of the present invention also include a DNAi oligonucleotide as defined below, either bound to the liposomes or sequestered in or on the liposomes. The molecules include, without limitation, DNAi oligonucleotides and/or other agents used to treat diseases such as cancer.

As used herein, an "amphoteric liposome" is a liposome with an amphoteric character, as defined above.

As used herein, sequestered, sequestering, or sequester refers to encapsulation, incorporation, or association of a DNAi oligonucleotide, with the lipids of a liposome. The DNAi oligonucleotide may be associated with the lipid bilayer or present in the aqueous interior of the liposome or both. It includes encapsulation in the aqueous core of the liposome. It also encompasses situations in which part or all of the DNAi oligonucleotide is located in the aqueous core of the liposome and part outside of the liposome in the aqueous phase of the liposomal suspension, where part of the DNAi oligonucleotide is located in the aqueous core of the liposome and part in the lipid portion of the liposome, or part sticking out of the liposomal exterior, where DNAi oligonucleotides are partially or totally embedded in the lipid portion of the liposome, and includes DNAi oligonucleotides associated with the liposomes, with all or part of the DNAi oligonucleotide associated with the exterior of the liposome.

As used herein, a Passive Loading Procedure (PLP) is a process wherein liposomes are charged with DNAi oligonucleotides and/or other molecules where the charges of the lipids are not useful for binding the oligonucleotides.

Advanced Loading Procedure (ALP) is an ion exchange process taking advantage of the positive charge of one lipid at acidic pH to bind the DNAi oligonucleotides.

As used herein, the term "non-human animals" refers to all non-human animals including, without limitation, vertebrates such as rodents, non-human primates, ovines, bovines, ruminants, lagomorphs, porcines, caprines, equines, canines, felines, aves, etc.

As used herein, the term "nucleic acid molecule", "nucleic acid sequence" or "polynucleotide" refers to any nucleic acid containing molecule, including without limitation, DNA or RNA. The term polynucleotide(s) generally refers to any polyribonucleotide or polydeoxyribonucleotide, which may be unmodified RNA or DNA or modified RNA or DNA. Thus, for instance, polynucleotides as used herein refers to, among others, single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions.

In addition, "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide.

The term "polynucleotide," "nucleic acid molecule" or "nucleic acid sequence" includes DNAs or RNAs that contain one or more modified bases. Thus, DNAs or RNAs with backbones modified for stability or for other reasons are "polynucloeotides," "nucleic acid molecules" or "nucleic acid sequences" as those terms are intended herein. The terms also encompass sequences that include any of the known base analogs of DNA and RNA.

It will be appreciated that a great variety of modifications have been made to DNA and RNA that serve many useful purposes known to those of skill in the art. The term "polynucleotide" as it is employed herein embraces such chemically, enzymatically or metabolically modified forms of polynucleotides, as well as the chemical forms of DNA and RNA characteristic of viruses and cells, including simple and complex cells, among others.

By "isolated nucleic acid sequence" is meant a polynucleotide that is not immediately contiguous with either of the coding sequences with which it is immediately contiguous (one on the 5' end and one on the 3' end) in the naturally occurring genome of the organism from which it is derived. The term therefore includes, for example, a recombinant DNA which is incorporated into a vector; into an autonomously replicating plasmid or virus; or into the genomic DNA of a prokaryote or eukaryote, or which exists as a separate molecule (e.g., a cDNA) independent of other sequences.

The term "gene" refers to a nucleic acid (e.g., DNA) sequence that includes coding sequences necessary for the production of a polypeptide, precursor or RNA (e.g., rRNA, tRNA). The polypeptide can be encoded by a full length coding sequence or by any portion of the coding sequence so long as the desired activity or functional properties (e.g., enzymatic activity, ligand binding, signal transduction, immunogenicity, etc.) of the full-length or fragment is retained. The term also encompasses the coding region of a structural gene and the sequences preceding and following the coding region, (leader and trailer) as well as intervening sequences (introns) between individual coding segments (exons). Sequences located 5' of the coding region and present on the mRNA are referred to as 5' non-translated sequences. Sequences located 3' or downstream of the coding region and present on the mRNA are referred to as 3' non-translated sequences. The term "gene" encompasses both cDNA and genomic forms of a gene. A genomic form or clone of a gene contains the coding region interrupted with non-coding sequences termed "introns" or "intervening regions" or "intervening sequences." Introns are segments of a gene that are transcribed into nuclear RNA (mRNA); introns may contain regulatory elements such as enhancers. Introns are removed or "spliced out" from the nuclear or primary transcript; introns therefore are absent in the messenger RNA (mRNA) transcript. The mRNA functions during translation to specify the sequence or order of amino acids in a nascent polypeptide.

As used herein, the term "gene expression" refers to the process of converting genetic information encoded in a gene into RNA (e.g., mRNA, rRNA, tRNA, micro RNA or snRNA) through "transcription" of the gene (i.e., via the enzymatic action of an RNA polymerase), and for protein encoding genes, into protein through "translation" of mRNA. Gene expression can be regulated at many stages in the process. "Up-regulation" or "activation" refers to regulation that increases the production of gene expression products (i.e., RNA or protein), while "down-regulation" or "repression" refers to regulation that decrease production. Molecules (e.g., transcription factors) that are involved in up-regulation or down-regulation are often called "activators" and "repressors," respectively.

In addition to containing introns, genomic forms of a gene may also include sequences located on both the 5' and 3' end of the sequences that are present on the RNA transcript. These sequences are referred to as "flanking" sequences or regions (these flanking sequences are located 5' or 3' to the non-translated sequences present on the mRNA transcript). The 5' flanking region (or upstream region) may contain regulatory sequences such as promoters and enhancers that control or influence the transcription of the gene. The 3' flanking region may contain sequences that direct the termination of transcription, post-transcriptional cleavage and polyadenylation.

As used herein, the terms "nucleic acid molecule encoding," "DNA sequence encoding," and "DNA encoding" refer to the order or sequence of deoxyribonucleotides along a strand of deoxyribonucleic acid. The order of these deoxyribonucleotides determines the order of amino acids along the polypeptide (protein) chain. The DNA sequence thus codes for the amino acid sequence.

The term "oligonucleotide" as used herein is defined as a molecule with two or more deoxyribonucleotides or ribonucleotides, often more than three, and usually more than ten. The exact size of an oligonucleotide will depend on many factors, including the ultimate function or use of the oligonucleotide. Oligonucleotides can be prepared by any suitable method, including, for example, cloning and restriction of appropriate sequences and direct chemical synthesis by a method such as the phosphotriester method of Narang et al., 1979, Meth. Enzymol., 68:90-99; the phosphodiester method of Brown et al., 1979, Method Enzymol., 68:109-151, the diethylphosphoramidite method of Beaucage et al., 1981, Tetrahedron Lett., 22:1859-1862; the triester method of Matteucci et al., 1981, J. Am. Chem. Soc., 103:3185-3191, or automated synthesis methods; and the solid support method of U.S. Pat. No. 4,458,066.

As used herein, a "DNAi oligonucleotide" or "DNAi" refers to a single stranded nucleic acid oligonucleotide or derivative thereof, whose sequence is complementary, in part, to a portion of the longest non-transcribed region of a gene in which the oligonucleotide affects indirectly or directly the expression, regulation or production of the same or different gene, wherein the longest non-transcribed region includes any portion of the gene that is not transcribed when the transcriptional start site is the site closest to the translation start site. DNAi does not include RNAi and antisense oligonucleotides that base pair only with mRNAs or pre-mRNAs and interfere with RNA processing and/or message translation.

In some embodiments utilizing methylated DNAi oligonucleotides, the nucleotide, dC is replaced by 5-methyl-dC where appropriate, as taught by the present invention.

The DNAi oligonucleotides may comprise, without limitation, oligonucleotide mimetics such as are described below. The DNAi oligonucleotide compounds in accordance with this invention may comprise from about 15 to about 35 nucleobases (i.e., from about 15 to about 35 linked bases), although both longer and shorter sequences may find use with the present invention.

Oligonucleotides may also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C) and uracil (U). Modified nucleobases include other synthetic and natural nucleobases.

In some embodiments, the DNAi oligonucleotides may hybridizes to the promoter region of a gene. In some embodiments, the hybridization of the DNAi oligonucleotide to the promoter inhibits expression of the gene.

By "promoter" is meant a sequence sufficient to direct transcription, including promoter elements that are sufficient to render promoter-dependent gene expression controllable for cell-type specific, tissue-specific, or inducible by external signals or agents; such elements may be located in the 5' or 3' regions of the gene. Both constitutive and inducible promoters, are included in the definition (see e.g., Bitter et al., *Methods in Enzymology* 153:516-544, 1987). For example, when cloning in bacterial systems, inducible promoters such as pL of bacteriophage γ, plac, ptrp, ptac (ptrp-lac hybrid promoter) and the like may be used. When cloning in mammalian cell systems, promoters derived from the genome of mammalian cells (e.g., metallothionein promoter) or from mammalian viruses (e.g., the retrovirus long terminal repeat; the adenovirus late promoter; the vaccinia virus 7.5K promoter) may be used. Promoters produced by recombinant DNA or synthetic techniques are also defined as promoters.

As used herein, the "regulatory region" of a gene is any part of a gene that regulates the expression of a gene, including, without limitation, transcriptional and translational regulation. The regions include without limitation the 5' and 3' regions of genes, binding sites for regulatory factors, including without limitation transcription factor binding sites. The regions also include regions that are as long as 20,000 or more base pairs upstream or downstream of translational start sites, so long as the region is involved in any way in the regulation of the expression of the gene. The region may be as short as 20 base pairs or as long as thousands of base pairs.

By "transformation" or "transfection" is meant a permanent or transient genetic change induced in a cell following incorporation of new DNA (i.e., DNA exogenous to the cell). Where the cell is a mammalian cell, a permanent genetic change is generally achieved by introduction of the DNA into the genome of the cell.

By "transformed cell" or "host cell" is meant a cell (e.g., prokaryotic or eukaryotic) into which (or into an ancestor of which) has been introduced, by means of recombinant DNA techniques, a DNA molecule encoding a polypeptide of the invention (i.e., a Methuselah polypeptide), or fragment thereof.

Transformation of a host cell with recombinant DNA may be carried out by conventional techniques as are well known to those skilled in the art. Where the host is prokaryotic, such as $E. coli$, competent cells which are capable of DNA uptake can be prepared from cells harvested after exponential growth phase and subsequently treated by the $CaCl_2$ method by procedures well known in the art. Alternatively, $MgCl_2$ or $RbCl$ can be used. Transformation can also be performed after forming a protoplast of the host cell or by electroporation.

As used herein, the terms "complementary" or "complementarity" are used in reference to polynucleotides (i.e., a sequence of nucleotides) related by the base-pairing rules. For example, for the sequence "A-G-T," is complementary to the sequence "T–C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands.

As used herein, the term "completely complementary," for example when used in reference to a DNAi oligonucleotide of the present invention refers to an oligonucleotide where all of the nucleotides are complementary to a target sequence (e.g., a gene).

As used herein, the term "partially complementary," refers to a sequence where at least one nucleotide is not complementary to the target sequence. Preferred partially complementary sequences are those that can still hybridize to the target sequence under physiological conditions. The term "partially complementary" refers to sequences that have regions of one or more non-complementary nucleotides both internal to the sequence or at either end. Sequences with mismatches at the ends may still hybridize to the target sequence.

The term "homology" refers to a degree of complementarity. There may be partial homology or complete homology (i.e., identity). A partially complementary sequence is a nucleic acid molecule that at least partially inhibits a completely complementary nucleic acid molecule from hybridizing to a target nucleic acid is "substantially homologous." The inhibition of hybridization of the completely complementary sequence to the target sequence may be examined using a hybridization assay (Southern or northern blot, solution hybridization and the like) under conditions of low stringency. A substantially homologous sequence or probe will compete for and inhibit the binding (i.e., the hybridization) of a completely homologous nucleic acid molecule to a target under conditions of low stringency. Likewise, a substantially complementary sequence or probe will compete for and inhibit the binding (i.e., the hybridization) of a completely complementary nucleic acid molecule to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that is substantially non-complementary (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

When used in reference to a single-stranded nucleic acid sequence, the term "substantially homologous" refers to any probe that can hybridize (i.e., it is the complement of) the single-stranded nucleic acid sequence under conditions of low stringency as described above.

As used herein, the term "hybridization" is used in reference to the pairing of complementary nucleic acids. Hybridization and the strength of hybridization (i.e., the strength of the association between the nucleic acids) is impacted by such factors as the degree of complementary between the nucleic acids, stringency of the conditions involved, the $T_m$ of the formed hybrid, and the G:C ratio within the nucleic acids. A single molecule that contains pairing of complementary nucleic acids within its structure is said to be "self-hybridized."

As used herein, the term "$T_m$" is used in reference to the "melting temperature." The melting temperature is the temperature at which a population of double-stranded nucleic acid molecules becomes half dissociated into single strands. The equation for calculating the $T_m$ of nucleic acids is well known in the art. As indicated by standard references, a simple estimate of the $T_m$ value may be calculated by the equation $T_m = 81.5 + 0.41$ (% G+C), when a nucleic acid is in aqueous solution at 1 M NaCl (See e.g., Anderson and Young, Quantitative Filter Hybridization, in Nucleic Acid Hybridization (1985)). Other references include more sophisticated computations that take structural as well as sequence characteristics into account for the calculation of $T_m$.

Inhibition of hybridization of the completely complementary sequence to the target sequence may be examined using a hybridization assay (Southern or northern blot, solution hybridization and the like) under conditions of low stringency. A substantially homologous sequence or probe will compete for and inhibit the binding (i.e., the hybridization) of a completely homologous nucleic acid molecule to a target under conditions of low stringency. This is not to say that conditions of low stringency are such that non-specific binding is permitted; low stringency conditions require that the binding of two sequences to one another be a specific (i.e., selective) interaction. The absence of non-specific binding may be tested by the use of a second target that is substantially non-complementary (e.g., less than about 30% identity); in the absence of non-specific binding the probe will not hybridize to the second non-complementary target.

When used in reference to a double-stranded nucleic acid sequence such as a cDNA or genomic clone, the term "substantially homologous" refers to any probe that can hybridize to either or both strands of the double-stranded nucleic acid sequence under conditions of low stringency as described above.

As used herein the term "stringency" is used in reference to the conditions of temperature, ionic strength and the presence of other compounds such as organic solvents, under which nucleic acid hybridizations are conducted. Under "low stringency conditions" a nucleic acid sequence of interest will hybridize to its exact complement, sequences with single base mismatches, closely related sequences (e.g., sequences with 90% or greater homology), and sequences having only partial homology (e.g., sequences with 50-90% homology). Under "medium stringency conditions," a nucleic acid sequence of interest will hybridize only to its exact complement, sequences with single base mismatches, and closely relation sequences (e.g., 90% or greater homology). Under "high stringency conditions," a nucleic acid sequence of interest will hybridize only to its exact complement, and (depending on conditions such a temperature) sequences with single base mismatches. In other words, under conditions of high stringency the temperature can be raised so as to exclude hybridization to sequences with single base mismatches.

As used herein, the term "physiological conditions" refers to specific stringency conditions that approximate or are conditions inside an animal (e.g., a human). Exemplary physiological conditions for use in vitro include, but are not limited to, 37° C., 95% air, 5% $CO_2$, commercial medium for culture of mammalian cells (e.g., DMEM media available from Gibco, Md.), 5-10% serum (e.g., calf serum or horse serum), additional buffers, and optionally hormone (e.g., insulin and epidermal growth factor).

The term "isolated" means altered "by the hand of man" from its natural state; i.e., if it occurs in nature, it has been changed or removed from its original environment or both. For example, when used in relation to a nucleic acid, as in "an isolated nucleotide" or "isolated polynucleotide" refers to a nucleic acid sequence that is identified and separated from at least one component or contaminant with which it is ordinarily associated in its natural source. Isolated nucleic acid as such present in a form or setting that is different from that in which it is found in nature. In contrast, non-isolated nucleic acids are nucleic acids such as DNA and RNA found in the state they exist in nature. For example, a given DNA sequence (e.g., a gene) is found on the host cell chromosome in proximity to neighboring genes; RNA sequences, such as a specific mRNA sequence encoding a specific protein, are found in the cell as a mixture with numerous other mRNAs that encode a multitude of proteins. However, isolated nucleic acid encoding a given protein includes, by way of example, such nucleic acid in cells ordinarily expressing the given protein where the nucleic acid is in a chromosomal location different from that of natural cells, or is otherwise flanked by a different nucleic acid sequence than that found in nature. The isolated nucleic acid, oligonucleotide or polynucleotide may be present in single-stranded or double-stranded form. When an isolated nucleic acid, oligonucleotide or polynucleotide is to be used to express a protein, the oligonucleotide or polynucleotide will contain at a minimum the sense or coding strand (i.e., the oligonucleotide or polynucleotide may be single-stranded), but may contain both the sense and antisense strands (i.e., the oligonucleotide or polynucleotide may be double-stranded).

As used herein, the term "purified" or "to purify" refers to removing components (e.g., contaminants) from a sample. For example, recombinant polypeptides are expressed in bacterial host cells and the polypeptides are purified by removing host cell proteins; the percent of recombinant polypeptides is thereby increased in the sample.

As used herein, the term "cell culture" refers to any in vitro culture of cells. Included within this term are continuous cell lines (e.g., with an immortal phenotype), primary cell cultures, transformed cell lines, finite cell lines (e.g., non-transformed cells), and any other cell population maintained in vitro.

As used, the term "eukaryote" refers to organisms distinguishable from "prokaryotes." It is intended that the term encompass all organisms with cells that exhibit the usual characteristics of eukaryotes, such as the presence of a true nucleus bounded by a nuclear membrane, within which lie the chromosomes, the presence of membrane-bound organelles and other characteristics commonly observed in eukaryotic organisms. Thus, the term includes, but is not limited to such organisms as fungi, protozoa and animals (e.g., humans).

As used herein, the term "in vitro" refers to an artificial environment and to processes or reactions that occur within an artificial environment. In vitro environments can consist of, but are not limited to, test tubes and cell culture. The term "in vivo" refers to the natural environment (e.g., an animal or a cell) and to processes or reaction that occur within a natural environment.

As used herein, the term "under conditions such that expression of a gene is inhibited" refers to conditions where a DNAi oligonucleotide of the present invention hybridizes to a gene (e.g., the promoter region of the gene) and inhibits transcription of the gene by at least 10%, at least 25%, at least 50% or at least 90% relative to the level of transcription in the absence of the oligonucleotide.

As used herein, the term "under conditions such that growth of a cell is reduced" refers to conditions where a DNAi oligonucleotide of the present invention, when administered to a cell (e.g., a cancer) reduces the rate of growth of the cell by at least 10%, at least 25%, at least 50% or at least 90% relative to the rate of growth of the cell in the absence of the oligonucleotide.

The terms "test compound" and "candidate compound" refer to any chemical entity, pharmaceutical, drug, biologic and the like that is a candidate for use to treat or prevent a disease, illness, sickness, or disorder of bodily function (e.g., cancer). Test compounds include both known and potential therapeutic compounds. A test compound can be determined to be therapeutic by screening using the screening methods of the present invention. In some embodiments of the present invention, the mixture includes a DNAi oligonucleotide a test compound such as an antisense compound or a chemotherapy agent.

As used herein, the term "chemotherapeutic agents" refers to compounds that can be useful in the treatment of disease (e.g., cancer). Exemplary chemotherapeutic agents affective against cancer include, without limitation, daunorubicin, dactinomycin, doxorubicin, bleomycin, mitomycin, nitrogen mustard, chlorambucil, melphalan, cyclophosphamide, 6-mercaptopurine, 6-thioguanine, cytarabine (CA), 5-fluorouracil (5-FU), floxuridine (5-FUdR), methotrexate (MTX), colchicine, taxotere, vincristine, vinblastine, etoposide, teniposide, cisplatin and diethylstilbestrol (DES).

For purposes of this invention, the chemical elements are identified in accordance with the Periodic Table of the Elements, CAS version, Handbook of Chemistry and Physics, 75$^{th}$ Ed. Additionally, general principles of organic chemistry are described in "Organic Chemistry", Thomas Sorrell, University Science Books, Sausalito: 1999, and "March's Advanced Organic Chemistry", 5th Ed., Ed.: Smith, M. B. and March, J., John Wiley & Sons, New York: 2001.

As used herein the term "aliphatic" encompasses the terms alkyl, alkenyl, alkynyl, each of which being optionally substituted as set forth below.

As used herein, an "alkyl" group refers to a saturated aliphatic hydrocarbon group containing 1-8 (e.g., 1-6 or 1-4) carbon atoms. An alkyl group can be straight or branched. Examples of alkyl groups include, but are not limited to, methyl, ethyl, propyl, isopropyl, butyl, isobutyl, sec-butyl, tert-butyl, n-pentyl, n-heptyl or 2-ethylhexyl. An alkyl group can be substituted (i.e., optionally substituted) with one or more substituents such as halo, cycloaliphatic, heterocycloaliphatic, aryl, heteroaryl, alkoxy, aroyl, heteroaroyl, cycloaliphaticcarbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, cycloaliphaticoxy, heterocycloaliphaticoxy, aryloxy, heteroaryloxy, aralkyloxy, heteroarylalkoxy, or hydroxy. Without limitation, some examples of substituted alkyls include carboxyalkyl (such as HOOC-alkyl, alkoxycarbonylalkyl and alkylcarbonyloxyalkyl), cyanoalkyl, hydroxyalkyl, alkoxyalkyl, acylalkyl, hydroxyalkyl, aralkyl, (alkoxyaryl)alkyl, (sulfonylamino)alkyl (such as (alkylsulfonylamino)alkyl), aminoalkyl, amidoalkyl, (cycloaliphatic)alkyl, cyanoalkyl, or haloalkyl.

As used herein, an "alkenyl" group refers to an aliphatic carbon group that contains 2-8 (e.g., 2-6 or 2-4) carbon atoms and at least one double bond. Like an alkyl group, an alkenyl group can be straight or branched. Examples of an alkenyl group include, but are not limited to, allyl, isoprenyl, 2-butenyl and 2-hexenyl. An alkenyl group can be optionally substituted with one or more substituents such as halo, cycloaliphatic, heterocycloaliphatic, aryl, heteroaryl, alkoxy, aroyl, heteroaroyl, (cycloaliphatic)carbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, (cycloaliphatic)oxy, (heterocycloaliphatic)oxy, aryloxy, heteroaryloxy, aralkyloxy, (heteroaryl)alkoxy, or hydroxy.

As used herein, an "alkynyl" group refers to an aliphatic carbon group that contains 2-8 (e.g., 2-6 or 2-4) carbon atoms and has at least one triple bond. An alkynyl group can be straight or branched. Examples of an alkynyl group include, but are not limited to, propargyl and butynyl. An alkynyl group can be optionally substituted with one or more substituents such as halo, cycloaliphatic, heterocycloaliphatic, aryl, heteroaryl, alkoxy, aroyl, heteroaroyl, (cycloaliphatic)carbonyl, (heterocycloaliphatic)carbonyl, nitro, cyano, amino, amido, acyl, sulfonyl, sulfinyl, sulfanyl, sulfoxy, urea, thiourea, sulfamoyl, sulfamide, oxo, carboxy, carbamoyl, (cycloaliphatic)oxy, (heterocycloaliphatic)oxy, aryloxy, heteroaryloxy, aralkyloxy, (heteroaryl)alkoxy, or hydroxy.

As used herein, an "amido" encompasses both "aminocarbonyl" and "carbonylamino". These terms when used alone or in connection with another group refers to an amido group such as $N(R^X)_2$—C(O)— or $R^Y C(O)$—$N(R^X)_2$— when used terminally and —C(O)—$N(R^X)$— or —$N(R^X)$—C(O)— when used internally, wherein $R^X$ and $R^Y$ are defined below.

Examples of amido groups include alkylamido (such as alkylcarbonylamino and alkylcarbonylamino), (heterocycloaliphatic) amido, (heteroaralkyl) amido, (heteroaryl) amido, (heterocycloalkyl)alkylamido, arylamido, aralkylamido, (cycloalkyl)alkylamido, and cycloalkylamido.

As used herein, an "amino" group refers to —$NR^X R^Y$ wherein each of $R^X$ and $R^Y$ is independently hydrogen, alkyl, cycloaliphatic, (cycloaliphatic)aliphatic, aryl, araliphatic, heterocycloaliphatic, (heterocycloaliphatic)aliphatic, heteroaryl, carboxy, sulfanyl, sulfinyl, sulfonyl, (aliphatic)carbonyl, (cycloaliphatic)carbonyl, ((cycloaliphatic)aliphatic)carbonyl, arylcarbonyl, (araliphatic)carbonyl, (heterocycloaliphatic)carbonyl, ((heterocycloaliphatic)aliphatic)carbonyl, (heteroaryl)carbonyl, or (heteroaraliphatic)carbonyl, each of which being defined herein and being optionally substituted. Examples of amino groups include alkylamino, dialkylamino, and arylamino.

When the term "amino" is not the terminal group (e.g., alkylcarbonylamino), it is represented by —$NR^X$—. $R^X$ has the same meaning as defined above.

As used herein, an "aryl" group used alone or as part of a larger moiety as in "aralkyl", "aralkoxy", or "aryloxyalkyl" refers to monocyclic (e.g., phenyl); bicyclic (e.g., indenyl, naphthalenyl, tetrahydronaphthyl, tetrahydroindenyl); and tricyclic (e.g., fluorenyl tetrahydrofluorenyl, or tetrahydroanthracenyl, anthracenyl). The bicyclic and tricyclic groups include benzofused 2-3 membered carbocyclic rings. For example, a benzofused group includes phenyl fused with two or more $C_{4-8}$ carbocyclic moieties. An aryl is optionally substituted with one or more substituents including aliphatic [e.g., alkyl, alkenyl, or alkynyl]; cycloaliphatic; (cycloaliphatic)aliphatic; heterocycloaliphatic; (heterocycloaliphatic)aliphatic; aryl; heteroaryl; alkoxy; (cycloaliphatic)oxy; (heterocycloaliphatic)oxy; aryloxy; heteroaryloxy; (araliphatic)oxy; (heteroaraliphatic)oxy; aroyl; heteroaroyl; amino; oxo (on a non-aromatic carbocyclic ring of a benzofused bicyclic or tricyclic aryl); nitro; carboxy; amido; acyl [e.g., aliphaticcarbonyl; (cycloaliphatic)carbonyl; ((cycloaliphatic)aliphatic)carbonyl; (araliphatic)carbonyl; (heterocycloaliphatic)carbonyl; ((heterocycloaliphatic) aliphatic)carbonyl; and (heteroaraliphatic)carbonyl]; sulfonyl [e.g., aliphaticsulfonyl and aminosulfonyl]; sulfinyl [e.g., aliphaticsulfinyl]; sulfanyl [e.g., aliphaticsulfanyl]; nitro; cyano; halo; hydroxyl; mercapto; sulfoxy; urea; thiourea; sulfamoyl; sulfamide; and carbamoyl. Alternatively, an aryl can be unsubstituted.

Non-limiting examples of substituted aryls include haloaryl [e.g., mono-, di (such as p,m-dihaloaryl), and (trihalo)aryl]; (carboxy)aryl [e.g., (alkoxycarbonyl)aryl, ((aralkyl)carbonyloxy)aryl, and (alkoxycarbonyl)aryl]; (amido)aryl [e.g., (aminocarbonyl)aryl, (((alkylamino)alkyl)aminocarbonyl)aryl, (alkylcarbonyl)aminoaryl, (arylaminocarbonyl)aryl, and (((heteroaryl)amino)carbonyl)aryl]; aminoaryl [e.g., ((alkylsulfonyl)amino)aryl and ((dialkyl)amino)aryl]; (cyanoalkyl)aryl; (alkoxy)aryl; (sulfamoyl)aryl [e.g., (aminosulfonyl)aryl]; (alkylsulfonyl)aryl; (cyano)aryl; (hydroxyalkyl)aryl; ((alkoxy)alkyl)aryl; (hydroxyl)aryl, ((carboxy)alkyl)aryl; (((dialkyl)amino)alkyl)aryl; (nitroalkyl)aryl; (((alkylsulfonyl)amino)alkyl)aryl; ((heterocycloaliphatic)carbonyl)aryl; ((alkylsulfonyl)alkyl)aryl; (cyanoalkyl)aryl; (hydroxyalkyl)aryl; (alkylcarbonyl)aryl; alkylaryl; (trihaloalkyl)aryl; p-amino-m-alkoxycarbonylaryl; p-amino-m-cyanoaryl; p-halo-m-aminoaryl; and (m-(heterocycloaliphatic)-o-(alkyl))aryl.

As used herein, an "araliphatic" such as an "aralkyl" group refers to an aliphatic group (e.g., a $C_{1-4}$ alkyl group) that is substituted with an aryl group. "Aliphatic," "alkyl," and "aryl" are defined herein. An example of an araliphatic such as an aralkyl group is benzyl.

As used herein, a "bicyclic ring system" includes 8-12 (e.g., 9, 10, or 11) membered structures that form two rings, wherein the two rings have at least one atom in common (e.g., 2 atoms in common). Bicyclic ring systems include bicycloaliphatics (e.g., bicycloalkyl or bicycloalkenyl), bicycloheteroaliphatics, bicyclic aryls, and bicyclic heteroaryls.

As used herein, a "cycloaliphatic" group encompasses a "cycloalkyl" group and a "cycloalkenyl" group, each of which being optionally substituted as set forth below.

As used herein, a "cycloalkyl" group refers to a saturated carbocyclic mono- or bicyclic (fused or bridged) ring of 3-10 (e.g., 5-10) carbon atoms. Examples of cycloalkyl groups include cyclopropyl, cyclobutyl, cyclopentyl, cyclohexyl, cycloheptyl, adamantyl, norbornyl, cubyl, octahydro-indenyl, decahydro-naphthyl, bicyclo[3.2.1]octyl, bicyclo[2.2.2]octyl, bicyclo[3.3.1]nonyl, bicyclo[3.3.2.]decyl, bicyclo[2.2.2]octyl, adamantyl, azacycloalkyl, or ((aminocarbonyl)cycloalkyl)cycloalkyl. A "cycloalkenyl" group, as used herein, refers to a non-aromatic carbocyclic ring of 3-10 (e.g., 4-8) carbon atoms having one or more double bonds. Examples of cycloalkenyl groups include cyclopentenyl, 1,4-cyclohexa-di-enyl, cycloheptenyl, cyclooctenyl, hexahydro-indenyl, octahydro-naphthyl, cyclohexenyl, cyclopentenyl, bicyclo[2.2.2]octenyl, and bicyclo[3.3.1]nonenyl.

A cycloalkyl or cycloalkenyl group can be optionally substituted with one or more substituents such as aliphatic [e.g., alkyl, alkenyl, or alkynyl], cycloaliphatic, (cycloaliphatic) aliphatic, heterocycloaliphatic, (heterocycloaliphatic) aliphatic, aryl, heteroaryl, alkoxy, (cycloaliphatic)oxy, (heterocycloaliphatic)oxy, aryloxy, heteroaryloxy, (araliphatic)oxy, (heteroaraliphatic)oxy, aroyl, heteroaroyl, amino, amido [e.g., (aliphatic)carbonylamino, (cycloaliphatic)carbonylamino, ((cycloaliphatic)aliphatic)carbonylamino, (aryl)carbonylamino, (araliphatic)carbonylamino, (heterocycloaliphatic)carbonylamino, ((heterocycloaliphatic) aliphatic)carbonylamino, (heteroaryl)carbonylamino, and (heteroaraliphatic)carbonylamino], nitro, carboxy [e.g., HOOC—, alkoxycarbonyl, and alkylcarbonyloxy], acyl [e.g., (cycloaliphatic)carbonyl, ((cycloaliphatic) aliphatic)carbonyl, (araliphatic)carbonyl, (heterocycloaliphatic)carbonyl, ((heterocycloaliphatic)aliphatic)carbonyl, and (heteroaraliphatic)carbonyl], nitro, cyano, halo, hydroxy, mercapto, sulfonyl [e.g., alkylsulfonyl and arylsulfonyl], sulfinyl [e.g., alkylsulfinyl], sulfanyl [e.g., alkylsulfanyl], sulfoxy, urea, thiourea, sulfamoyl, sulfamide, oxo, or carbamoyl.

As used herein, "cyclic moiety" includes cycloaliphatic, heterocycloaliphatic, aryl, or heteroaryl, each of which has been defined previously.

As used herein, the term "heterocycloaliphatic" encompasses a heterocycloalkyl group and a heterocycloalkenyl group, each of which being optionally substituted as set forth below.

As used herein, a "heterocycloalkyl" group refers to a 3-10 membered mono- or bicyclic (fused or bridged) (e.g., 5- to 10-membered mono- or bicyclic) saturated ring structure, in which one or more of the ring atoms is a heteroatom (e.g., N, O, S, or combinations thereof). Examples of a heterocycloalkyl group include piperidyl, piperazyl, tetrahydropyranyl, tetrahydrofuryl, 1,4-dioxolanyl, 1,4-dithianyl, 1,3-dioxolanyl, oxazolidyl, isoxazolidyl, morpholinyl, thiomorpholyl, octahydro-benzofuryl, octahydro-chromenyl, octahydro-thiochromenyl, octahydro-indolyl, octahydro-pyrindinyl, decahydro-quinolinyl, octahydro-benzo[b]thiopheneyl, 2-oxa-bicyclo[2.2.2]octyl, 1-aza-bicyclo[2.2.2]octyl, 3-aza-bicyclo[3.2.1]octyl, and 2,6-dioxa-tricyclo[3.3.1.0$^{3,7}$]nonyl. A monocyclic heterocycloalkyl group can be fused with a phenyl moiety such as tetrahydroisoquinoline. A "heterocycloalkenyl" group, as used herein, refers to a mono- or bicyclic (e.g., 5- to 10-membered mono- or bicyclic) non-aromatic ring structure having one or more double bonds, and wherein one or more of the ring atoms is a heteroatom (e.g., N, O, or S). Monocyclic and bicycloheteroaliphatics are numbered according to standard chemical nomenclature.

A heterocycloalkyl or heterocycloalkenyl group can be optionally substituted with one or more substituents such as aliphatic [e.g., alkyl, alkenyl, or alkynyl], cycloaliphatic, (cycloaliphatic) aliphatic, heterocycloaliphatic, (heterocycloaliphatic) aliphatic, aryl, heteroaryl, alkoxy, (cycloaliphatic)oxy, (heterocycloaliphatic)oxy, aryloxy, heteroaryloxy, (araliphatic)oxy, (heteroaraliphatic)oxy, aroyl, heteroaroyl, amino, amido [e.g., (aliphatic)carbonylamino, (cycloaliphatic)carbonylamino, ((cycloaliphatic) aliphatic)carbonylamino, (aryl)carbonylamino, (araliphatic)carbonylamino, (heterocycloaliphatic)carbonylamino, ((heterocycloaliphatic) aliphatic)carbonylamino, (heteroaryl)carbonylamino, and (heteroaraliphatic)carbonylamino], nitro, carboxy [e.g., HOOC—, alkoxycarbonyl, and alkylcarbonyloxy], acyl [e.g., (cycloaliphatic)carbonyl, ((cycloaliphatic) aliphatic)carbonyl, (araliphatic)carbonyl, (heterocycloaliphatic)carbonyl, ((heterocycloaliphatic)aliphatic)carbonyl, and (heteroaraliphatic)carbonyl], nitro, cyano, halo, hydroxy, mercapto, sulfonyl [e.g., alkylsulfonyl and arylsulfonyl], sulfinyl [e.g., alkylsulfinyl], sulfanyl [e.g., alkylsulfanyl], sulfoxy, urea, thiourea, sulfamoyl, sulfamide, oxo, or carbamoyl.

A "heteroaryl" group, as used herein, refers to a monocyclic, bicyclic, or tricyclic ring structure having 4 to 15 ring atoms wherein one or more of the ring atoms is a heteroatom (e.g., N, O, S, or combinations thereof) and wherein one or more rings of the bicyclic or tricyclic ring structure is aromatic. A heteroaryl group includes a benzofused ring system having 2 to 3 rings. For example, a benzofused group includes benzo fused with one or two 4 to 8 membered heterocycloaliphatic moieties (e.g., indolizyl, indolyl, isoindolyl, 3H-indolyl, indolinyl, benzo[b]furyl, benzo[b]thiophenyl, quinolinyl, or isoquinolinyl). Some examples of heteroaryl are azetidinyl, pyridyl, 1H-indazolyl, furyl, pyrrolyl, thienyl, thiazolyl, oxazolyl, imidazolyl, tetrazolyl, benzofuryl, isoquinolinyl, benzthiazolyl, xanthene, thioxanthene, phenothiazine, dihydroindole, benzo[1,3]dioxole, benzo[b]furyl, benzo[b]thiophenyl, indazolyl, benzimidazolyl, benzthiazolyl, puryl, cinnolyl, quinolyl, quinazolyl, cinnolyl, phthalazyl, quinazolyl, quinoxalyl, isoquinolyl, 4H-quinolizyl, benzo-1,2,5-thiadiazolyl, or 1,8-naphthyridyl.

Without limitation, monocyclic heteroaryls include furyl, thiophenyl, 2H-pyrrolyl, pyrrolyl, oxazolyl, thazolyl, imidazolyl, pyrazolyl, isoxazolyl, isothiazolyl, 1,3,4-thiadiazolyl, 2H-pyranyl, 4-H-pranyl, pyridyl, pyridazyl, pyrimidyl, pyrazolyl, pyrazyl, or 1,3,5-triazyl. Monocyclic heteroaryls are numbered according to standard chemical nomenclature.

Without limitation, bicyclic heteroaryls include indolizyl, indolyl, isoindolyl, 3H-indolyl, indolinyl, benzo[b]furyl, benzo[b]thiophenyl, quinolinyl, isoquinolinyl, indazolyl, benzimidazyl, benzthiazolyl, purinyl, 4H-quinolizyl, quinolyl, isoquinolyl, cinnolyl, phthalazyl, quinazolyl, quinoxalyl, 1,8-naphthyridyl, or pteridyl. Bicyclic heteroaryls are numbered according to standard chemical nomenclature.

A heteroaryl is optionally substituted with one or more substituents such as aliphatic [e.g., alkyl, alkenyl, or alkynyl]; cycloaliphatic; (cycloaliphatic)aliphatic; heterocycloaliphatic; (heterocycloaliphatic)aliphatic; aryl; heteroaryl; alkoxy; (cycloaliphatic)oxy; (heterocycloaliphatic) oxy; aryloxy; heteroaryloxy; (araliphatic)oxy; (heteroaraliphatic)oxy; aroyl; heteroaroyl; amino; oxo (on a non-aromatic carbocyclic or heterocyclic ring of a bicyclic or tricyclic heteroaryl); nitro; carboxy; amido; acyl [e.g., aliphaticcarbonyl; (cycloaliphatic)carbonyl; ((cycloaliphatic) aliphatic)carbonyl; (araliphatic)carbonyl; (heterocycloaliphatic)carbonyl; ((heterocycloaliphatic) aliphatic) carbonyl; and (heteroaraliphatic)carbonyl]; sulfonyl [e.g., aliphaticsulfonyl and aminosulfonyl]; sulfinyl [e.g., aliphaticsulfinyl]; sulfanyl [e.g., aliphaticsulfanyl]; nitro; cyano; halo; hydroxyl; mercapto; sulfoxy; urea; thiourea; sulfamoyl; sulfamide; or carbamoyl. Alternatively, a heteroaryl can be unsubstituted.

Non-limiting examples of substituted heteroaryls include (halo)heteroaryl [e.g., mono- and di-(halo)heteroaryl]; (carboxy)heteroaryl [e.g., (alkoxycarbonyl)heteroaryl]; cyanoheteroaryl; aminoheteroaryl [e.g., ((alkylsulfonyl)amino)heteroaryl and ((dialkyl)amino)heteroaryl]; (amido)heteroaryl [e.g., aminocarbonylheteroaryl, ((alkylcarbonyl)amino)heteroaryl, ((((alkyl)amino)alkyl)aminocarbonyl)heteroaryl, (((heteroaryl)amino)carbonyl)heteroaryl, ((heterocycloaliphatic)carbonyl)heteroaryl, and ((alkylcarbonyl) amino)heteroaryl]; (cyanoalkyl)heteroaryl; (alkoxy)heteroaryl; (sulfamoyl)heteroaryl [e.g., (aminosulfonyl) heteroaryl]; (sulfonyl)heteroaryl [e.g., (alkylsulfonyl) heteroaryl]; (hydroxyalkyl)heteroaryl; (alkoxyalkyl) heteroaryl; (hydroxyl)heteroaryl; ((carboxy)alkyl) heteroaryl; [((dialkyl)amino)alkyl]heteroaryl; (heterocycloaliphatic)heteroaryl; (cycloaliphatic)heteroaryl; (nitroalkyl)heteroaryl; (((alkylsulfonyl)amino)alkyl)heteroaryl; ((alkylsulfonyl)alkyl)heteroaryl; (cyanoalkyl)heteroaryl; (acyl)heteroaryl [e.g., (alkylcarbonyl)heteroaryl]; (alkyl)heteroaryl, and (haloalkyl)heteroaryl [e.g., trihaloalkylheteroaryl].

A "heteroaliphatic (such as a heteroaralkyl group) as used herein, refers to an aliphatic group (e.g., a $C_{1-4}$ alkyl group) that is substituted with a heteroaryl group. "Aliphatic," "alkyl," and "heteroaryl" have been defined above.

As used herein, an "acyl" group refers to a formyl group or $R^X$—C(O)— (such as -alkyl-C(O)—, also referred to as "alkylcarbonyl") where $R^X$ and "alkyl" have been defined previously. Acetyl and pivaloyl are examples of acyl groups.

As used herein, an "alkoxy" group refers to an alkyl-O— group where "alkyl" has been defined previously.

As used herein, a "carbamoyl" group refers to a group having the structure —O—CO—$NR^XR^Y$ or —$NR^X$—CO—O—$R^Z$ wherein $R^X$ and $R^Y$ have been defined above and $R^Z$ can be aliphatic, aryl, araliphatic, heterocycloaliphatic, heteroaryl, or heteroaraliphatic.

As used herein, a "carboxy" group refers to —COOH, —$COOR^X$, —OC(O)H, —OC(O)$R^X$ when used as a terminal group or —OC(O)— or —C(O)O—; when used as an internal group.

As used herein, a "haloaliphatic" group refers to an aliphatic group substituted with 1-3 halogen. For instance, the term haloalkyl includes the group —$CF_3$.

As used herein, a "mercapto" group refers to —SH.

As used herein, a "sulfo" group refers to —$SO_3H$ or —$SO_3R^X$ when used terminally or —S(O)3-when used internally.

As used herein, a "sulfamide" group refers to the structure —$NR^X$—S(O)$_2$—$NR^YR^Z$ when used terminally and —$NR^X$—S(O)$_2$—$NR^Y$— when used internally, wherein $R^X$, $R^Y$, and $R^Z$ have been defined above.

As used herein, a "sulfamoyl" group refers to the structure —S(O)$_2$—$NR^XR^Y$ or —$NR^X$—S(O)$_2$-$R^Z$ when used terminally or —S(O)$_2$—$NR^X$— or —$NR^X$—S(O)$_2$— when used internally, wherein $R^X$, $R^Y$, and $R^Z$ are defined above.

As used herein a "sulfanyl" group refers to —S—$R^X$ when used terminally and —S— when used internally, wherein $R^X$ has been defined above. Examples of sulfanyls include alkylsulfanyl.

As used herein a "sulfinyl" group refers to —S(O)—$R^X$ when used terminally and —S(O)—when used internally, wherein $R^X$ has been defined above.

As used herein, a "sulfonyl" group refers to —S(O)$_2$—$R^X$ when used terminally and —S(O)$_2$— when used internally, wherein $R^X$ has been defined above.

As used herein, a "sulfoxy" group refers to —O—SO—$R^X$ or —SO—O-Rx, when used terminally and —O—S(O)— or —S(O)—O— when used internally, where $R^X$ has been defined above.

As used herein, a "halogen" or "halo" group refers to fluorine, chlorine, bromine or iodine.

As used herein, an "alkoxycarbonyl," which is encompassed by the term carboxy, used alone or in connection with another group refers to a group such as alkyl-O—C(O)—.

As used herein, an "alkoxyalkyl" refers to an alkyl group such as alkyl-O-alkyl-, wherein alkyl has been defined above.

As used herein, a "carbonyl" refers to —C(O)—.

As used herein, an "oxo" refers to =O.

As used herein, an "aminoalkyl" refers to the structure $(R^X)_2$N-alkyl-.

As used herein, a "cyanoalkyl" refers to the structure (NC)-alkyl-

As used herein, a "urea" group refers to the structure —$NR^X$—CO—$NR^YR^Z$ and a "thiourea" group refers to the structure —$NR^X$—CS—$NR^YR^Z$ when used terminally and —$NR^X$—CO—$NR^Y$— or —$NR^X$—CS—$NR^Y$— when used internally, wherein $R^X$, $R^Y$, and $R^Z$ have been defined above.

As used herein, a "guanidino" group refers to the structure —N=C(N($R^XR^Y$))N($R^XR^Y$) wherein $R^X$ and $R^Y$ have been defined above.

As used herein, the term "amidino" group refers to the structure —C=($NR^X$)N($R^XR^Y$) wherein $R^X$ and $R^Y$ have been defined above.

The terms "terminally" and "internally" refer to the location of a group within a substituent. A group is terminal when the group is present at the end of the substituent not further bonded to the rest of the chemical structure. Carboxyalkyl, i.e., $R^XO(O)$C-alkyl is an example of a carboxy group used terminally. A group is internal when the group is present in the middle of a substituent to at the end of the substituent bound to the to the rest of the chemical structure. Alkylcarboxy (e.g., alkyl-C(O)O— or alkyl-OC(O)—) and alkylcarboxyaryl (e.g., alkyl-C(O)O-aryl- or alkyl-O(CO)-aryl-) are examples of carboxy groups used internally.

The phrase "optionally substituted" is used interchangeably with the phrase "substituted or unsubstituted." As described herein, compounds of the invention can optionally be substituted with one or more substituents, such as are illustrated generally above, or as exemplified by particular classes, subclasses, and species of the invention. As described herein, the variables contained herein encompass specific groups, such as alkyl and aryl. Unless otherwise noted, each of the specific groups for the variables contained herein can be optionally substituted with one or more substituents described herein. Each substituent of a specific group is further optionally substituted with one to three of halo, cyano, oxoalkoxy, hydroxyl, amino, nitro, aryl, haloalkyl, and alkyl.

For instance, an alkyl group can be substituted with alkylsulfanyl and the alkylsulfanyl can be optionally substituted with one to three of halo, cyano, oxoalkoxy, hydroxyl, amino, nitro, aryl, haloalkyl, and alkyl. As an additional example, the cycloalkyl portion of a (cycloalkyl)carbonylamino can be optionally substituted with one to three of halo, cyano, alkoxy, hydroxyl, nitro, haloalkyl, and alkyl. When two alkoxy groups are bound to the same atom or adjacent atoms, the two alkxoy groups can form a ring together with the atom(s) to which they are bound.

In general, the term "substituted," whether preceded by the term "optionally" or not, refers to the replacement of hydrogen radicals in a given structure with the radical of a specified substituent. Specific substituents are described above in the definitions and below in the description of compounds and examples thereof. Unless otherwise indicated, an optionally substituted group can have a substituent at each substitutable position of the group, and when more than one position in any given structure can be substituted with more than one substituent selected from a specified group, the substituent can be either the same or different at every position. A ring substituent, such as a heterocycloalkyl, can be bound to another ring, such as a cycloalkyl, to form a spiro-bicyclic ring system, e.g., both rings share one common atom. As one of ordinary skill in the art will recognize, combinations of substituents envisioned by this invention are those combinations that result in the formation of stable or chemically feasible compounds.

The phrase "stable or chemically feasible," as used herein, refers to compounds that are not substantially altered when subjected to conditions to allow for their production, detection, and preferably their recovery, purification, and use for one or more of the purposes disclosed herein.

As used herein, an effective amount is defined as the amount required to confer a therapeutic effect on the treated patient, and is typically determined based on age, surface area, weight and condition of the patient. The interrelationship of dosages for animals and humans (based on milligrams per meter squared of body surface) is described by Freireich et al., *Cancer Chemother. Rep.*, 50: 219 (1966). Body surface area can be approximately determined from height and weight of the patient. See, e.g., Scientific Tables, Geigy Pharmaceuticals, Ardsley, N.Y., 537 (1970).

Unless otherwise stated, structures depicted herein are also meant to include all isomeric (e.g., enantiomeric, diastereomeric, and geometric (or conformational)) forms of the structure; for example, the R and S configurations for each asymmetric center, (Z) and (E) double bond isomers, and (Z) and (E) conformational isomers. Therefore, single stereochemical isomers as well as enantiomeric, diastereomeric, and geometric (or conformational) mixtures of the present compounds are within the scope of the invention. Unless otherwise stated, all tautomeric forms of the compounds of the invention are within the scope of the invention. Additionally, unless otherwise stated, structures depicted herein are also meant to include compounds that differ only in the presence of one or more isotopically enriched atoms. For example, compounds having the present structures except for the replacement of hydrogen by deuterium or tritium, or the replacement of a carbon by a $^{13}$C- or $^{14}$C-enriched carbon are within the scope of this invention. Such compounds are useful, for example, as analytical tools or probes in biological assays.

II. Oncogene Targets

In some embodiments, the present invention provides antigene inhibitors of oncogenes. The present invention is not limited to the inhibition of a particular oncogene. Indeed, the present invention encompasses antigene inhibitors to any number of oncogenes including, but not limited to, those disclosed herein.

A. Ras

One gene which has captured the attention of many scientists is the human proto-oncogene, c-Ha-ras. This gene acts as a central dispatcher, relaying chemical signals into cells and controlling cell division. Ras gene alteration may cause the gene to stay in the "on" position. The ras oncogene is believed to underlie up to 30% of cancer, including colon cancer, lung cancer, bladder and mammary carcinoma (Bos, Cancer Res. 49:4682-4689 [1989]). The ras oncogene has therefore become a target for therapeutic drugs.

There are several reports showing that oligonucleotides complementary to various sites of ras mRNA can inhibit synthesis of ras protein (p21), which decreases the cell proliferation rate in cell culture (U.S. Pat. No. 5,576,208; U.S. Pat. No. 5,582,986; Daska et al., Oncogene Res. 5:267-275 [1990]; Brown et al., Oncogene Res. 4:243-252 [1989]; Saison-Behmoaras et al., EMBO J. 10:1111-1116 [1991]). Oligonucleotides complementary to the 5' flanking region of the c-Ha-ras RNA transcript have shown to inhibit tumor growth in nude mice for up to 14 days (Gray et al., Cancer Res. 53:577-580 [1993]). It was recently reported that an antisense oligonucleotide directed to a point mutation (G>C) in codon 12 of the c-Ha-ras mRNA inhibited cell proliferation as well as tumor growth in nude mice when it was injected subcutaneously (U.S. Pat. No. 5,576,208; U.S. Pat. No. 5,582,986; Schwab et al., Proc. Natl. Acad. Sci. USA 91:10460-10464 [1994]; each of which is herein incorporated by reference). Researchers have also reported that antisense drugs shrank ovarian tumors in small clinical trials (Roush et al., Science 276:1192-1194 [1997]).

B. Her-2

The -her-2 (also known as neu oncogene or erbB-2) oncogene encodes a receptor-like tyrosine kinase (RTK) that has been extensively investigated because of its role in several human carcinomas (Hynes and Stern, Biochim. et Biophy. Acta 1198:165-184 [1994]; Dougall et al., Oncogene 9:2109-2123 [1994]) and in mammalian development (Lee et al., Nature 378:394-398 [1995]). Her-2 is one of the most frequently altered genes in cancer. It encodes a transmembrane receptor (also known as p185) with tyrosine kinase activity and is a member of the epidermal growth factor (EGF) family, and thus is related to the epidermal growth factor receptor (EGFR or HER-1). Aberrant her-2 gene expression is present in a wide variety of cancers and is most common in breast, ovarian and gastric cancers. HER-2 is overexpressed in 25-30% of all human breast and ovarian cancers. Levels of HER-2 overexpression correlate well with clinical stage of breast cancer, prognosis and metastatic potential. Overexpression of HER-2 is associated with lower survival rates, increased relapse rates and increased metastatic potential. Tan et al., (Cancer Res., 57:1199 [1997]) have shown that overexpression of the HER-2 gene increases the metastatic potential of breast cancer cells without increasing their transformation ability.

Aberrant expression of HER-2 includes both increased expression of normal HER-2 and expression of mutant HER-2. Activation of the her-2 proto-oncogene can occur by any of three mechanisms—point mutation, gene amplification and overexpression. Gene amplification is the most common mechanism. Unlike the other EGF family members for whom ligand activation is necessary for promoting transformation, overexpression of HER-2 alone is sufficient for transformation (Cohen, et al., J. Biol. Chem., 271:30897 [1996]).

Several therapeutic approaches have been used to reduce levels of the her-2 gene product. The adenovirus type 5 gene product E1A has been studied as a potential therapeutic using a breast cancer model in nude mice. This gene product can repress her-2/neu overexpression by repressing her-2/neu promoter activity, and suppress the tumorigenic potential of her-2/neu-overexpressing ovarian cancer cells. In mice bearing her-2/neu-overexpressing breast cancer xenografts, E1A delivered either by adenovirus or liposome significantly inhibited tumor growth and prolonged mouse survival compared with the controls (Chang et al., Oncogene 14:561 [1997]). Clinical trials have been conducted to evaluate a bispecific antibody which targets the extracellular domains of both the HER-2/neu protein product and Fc gamma RIII (CD16), the Fc gamma receptor expressed by human natural killer cells, neutrophils, and differentiated mononuclear phagocytes (Weiner et al., J. Hematotherapy, 4:471 [1995]).

Overexpression of HER-2 has also been found to be associated with increased resistance to chemotherapy. Thus, patients with elevated levels of HER-2 respond poorly to many drugs. Methods used to inhibit HER-2 expression have been combined with commonly used chemotherapeutic agents (Ueno et al., Oncogone 15:953 [1997]). Combining the adenovirus type 5 gene product, E1A, with taxol showed a synergistic effect in human breast cancer cells. Zhang et al., (Oncogene, 12:571 [1996]) demonstrated that emodin, a tyrosine-specific inhibitor, sensitized non-small cell lung cancer (NSCLC) cells to a variety of chemotherapeutic drugs, including cisplatin, doxorubicin and etoposide. A HER-2 antibody was found to increase the efficacy of tamoxifen in human breast cancer cells (Witters et al., Breast Cancer Res. and Treatment, 42:1 [1997]).

Oligonucleotides have also been used to study the function of HER-2. A triplex-forming oligonucleotide targeted to the her-2 promoter, 42 to 69 nucleotides upstream of the mRNA transcription start site was found to inhibit HER-2 expression in vitro (Ebbinghaus et al., J. Clin. Invest., 92:2433 [1993]). Porumb et al. (Cancer Res., 56:515 [1996]) also used a triplex-forming oligonucleotide targeted to the same her-2 promoter region. Decreases in her-2 mRNA and protein levels were seen in cultured cells. Juhl et al. (J. Biol. Chem., 272: 29482 [1997]) used anti-her-2 ribozymes targeted to a central region of the her-2 RNA just downstream of the transmembrane region of the protein to demonstrate a reduction in her-2 mRNA and protein levels in human ovarian cancer cells. A reduction in tumor growth in nude mice was also seen.

An antisense approach has been used as a potential therapeutic for HER-2 overexpressing cancers. Pegues et al. (Cancer Lett., 117:73 [1997]) cloned a 1.5 kb fragment of her-2 in an antisense orientation into an expression vector; transfecting of this construct into ovarian cancer cells resulted in a reduction of anchorage-independent growth. Casalini et al. (Int. J. Cancer 72:631 [1997]) used several human her-2 antisense vector constructs, containing her-2 fragments from 151 bp to 415 bp in length, to demonstrate reduction in HER-2 protein levels and anchorage-independent growth in lung adenocarcinoma cells. Colomer et al. (Br. J. Cancer, 70:819 [1994]) showed that phosphodiester antisense oligonucleotides targeted at or immediately downstream of, the translation initiation codon inhibited proliferation of human breast cancer cells by up to 60%. Wiechen et al. (Int. J. Cancer 63:604 [1995]) demonstrated that an 18-nucleotide phosphorothioate oligonucleotide targeted to the coding region, 33 nucleotides downstream of the translation initiation codon, of her-2 reduced anchorage-independent growth of ovarian cancer cells. Bertram et al. (Biochem. Biophys. Res. Commun., 200:661 [1994]) used antisense phosphorothioate oligonucleotides targeted to the translation initiation region and a sequence at the 3' part of the translated region of the mRNA which has high homology to a tyrosine kinase consensus sequence, and demonstrated a 75% reduction in HER-2 protein levels in human breast cancer cells. Liu et al., (Antisense and Nucleic Acid Drug Develop., 6:9 [1996]) used antisense phosphorothioate oligonucleotides targeted to the 5' cap site and coding region. The most effective oligonucleotide, targeted to the 5' cap site, reduced HER-2 protein expression by 90%. Cell proliferation was also reduced by a comparable amount. Vaughn et al. (Nuc. Acids Res., 24:4558 [1996]) used phosphorothioate, phosphorodithioate and chimeric antisense oligonucleotides targeted at or adjacent to (either side) the translation initiation region of her-2. An alternating dithioate/diester oligonucleotide targeted to the translation initiation region worked slightly better than an all phosphorothioate oligonucleotide. Brysch et al. (Cancer Gene Ther., 1:99 [1994]) used chemically modified antisense oligonucleotides targeted to the translation initiation codon of HER-2 to reduce protein levels and cause growth arrest of human breast cancer cell line.

C. C-Myc

The c-myc gene product is encoded by an immediate early response gene, the expression of which can be induced by various mitogens. C-myc expression is involved in signal transduction pathways leading to cell division. Studies have demonstrated that proliferating cells have higher levels of c-myc mRNA and c-myc protein than do quiescent cells. Antibodies directed against the human c-myc protein are known to inhibit DNA synthesis in nuclei isolated from human cells. Conversely, constitutive expression of c-myc produced by gene transfer inhibits induced differentiation of several cell lines. Constitutive expression of c-myc predisposes transgenic mice to the development of tumors.

Some studies have suggested that the c-myc gene product may play a proliferative role in smooth muscle cells (SMCs). Balloon de-endothelialization and injury of rat aortas is known to increase c-myc mRNA expression of vascular SMC prior to their subsequent proliferation and migration. Also, SMCs in culture proliferate when exposed to several mitogens, including PDGF, FGF, EGF, IGF-1 and to serum. Each of these mitogens has been found to be capable of increasing the expression in other cell lines of either c-myc protein, c-myc mRNA, or both. Additionally, blood serum has been found to increase c-myc mRNA levels in SMCs.

Harel-Bellan et al. (J. Immun. 140; 2431-2435 (1988)) demonstrated that antisense oligonucleotides complementary to c-myc mRNA effectively inhibited the translation thereof in human T cells. These T cells were prevented from entering the S phase of cell division. c-myc proto-oncogene sequences are described in Marcu et al., Ann. Rev. Biochem., 61:809-860 [1992]; Watt et al., Nature, 303:725-728 [1983)]; Battey et al., Cell, 34:779-787 (1983); and Epstein et al, NTIS publication PB93-100576

D. Bcl-2

In many types of human tumors, including lymphomas and leukemias, the bcl-2 gene is overexpressed, and may be associated with tumorigenicity (Tsujimoto et al., Science 228: 1440-1443 [1985]). High levels of expression of the bcl-2 gene have been found in all lymphomas with t (14; 18) chromosomal translocations including most follicular B cell lymphomas and many large cell non-Hodgkin's lymphomas. High levels of expression of the bcl-2 gene have also been found in certain leukemias that do not have a t(14; 18) chromosomal translation, including most cases of chronic lymphocytic leukemia acute, many lymphocytic leukemias of the pre-B cell type, neuroblastomas, nasopharyngeal carcinomas, and many adenocarcinomas of the prostate, breast and colon. (Reed et al., Cancer Res. 51:6529 [1991]; Yunis et al., New England J. Med. 320:1047; Campos et al., Blood 81:3091-3096 [1993]; McDonnell et al., Cancer Res. 52:6940-6944 [1992]; Lu et al., Int. J. Cancer 53:29-35 [1993]; Bonner et al., Lab Invest. 68:43A [1993]).

E. TGF-α

Transforming Growth Factor Alpha (TGF-α) is a polypeptide of 50 amino acids. It was first isolated from a retrovirus-transformed mouse cell line and subsequently was identified in human tumor cells, in early rat embryo cells and in cell cultures from the human pituitary gland. TGF-α is closely related to Epidermal Growth Factor (EGF), both structurally and functionally, and both bind to the same receptor, i.e., Epidermal Growth Factor Receptor (EGFR). The sequence and three dimensional structure of both EGF and TGF-α have been determined (Campbell et al., Prog. Growth Factor Res. 1:13 [1989]). TGF-α is a 50 amino acid polypeptide having about 40% homology of residues with EGF. Both peptides are characterized by three well defined loops (denoted A, B and C) and have three intramolecular disulphide bonds.

Several growth factors, including TGF-α and EGF, are believed to exert their biological effects via interaction with the Epidermal Growth Factor Receptor (EGF Receptor). The EGF Receptor is a Type 1 receptor tyrosine kinase. The EGF Receptor and its ligands are of interest for their roles in normal physiological processes as well as in hyperproliferative and neoplastic diseases.

The in vivo precursor of TGF-α is a 160 amino acid residue membrane-bound protein (pro-TGF-.alpha.) that is cleaved to yield a soluble compound (Massague, J. Biol. Chem., 265: 21393-21396 [1990]). This cleavage removes an extracellular portion comprised of 50 amino acids with a molecular weight of 6 Kd and is considered to be an important regulatory event (Pandiella et al., Proc. Natl. Acad. Sci. USA, 88:1726-1730 [1990]) that can be stimulated by phorbol esters acting via protein kinase C (Pandiella et al., J. Biol. Chem., 266:5769-5773 [1991]).

Cultured human prostatic tumor lines contain elevated levels of TGF-α mRNA and proliferate in response to TGF-α (Wilding et al., The Prostate, 15:1-12 [1989]). TGF-α appears to have both autocrine and paracrine function, stimulating physiologic activities such as cell division and angiogenesis. When induced in transgenic mice, TGF-α produced epithelial hyperplasia and focal dysplastic changes that resembled carcinoma in situ (Sandgren et al., Cell, 61:1121-1135 [1990]).

F. c-ki-Ras

The c-Ki-Ras (KRAS) oncogene is expressed ubiquitously. KRAS, with a length of more than 30 kb, is much larger than HRAS or NRAS. Although the 3 ras genes, HRAS, KRAS, and NRAS, have different genetic structures, all code for proteins of 189 amino acid residues, generically designated p21. These genes acquire malignant properties by single point mutations that affect the incorporation of the 12th or 61st amino acid residue of their respective p21. KRAS is involved in malignancy much more often than is HRAS. In a study of 96 human tumors or tumor cell lines in the NIH 3T3 transforming system, (Pulciani et al., *Nature* 300: 539 (1982) found a mutated HRAS locus only in T24 bladder cancer cells, whereas transforming KRAS genes were identified in 8 different carcinomas and sarcomas.

In a serous cystadenocarcinoma of the ovary, Feig et al. (*Science* 223: 698 (1984)) showed the presence of an activated KRAS oncogene not activated in normal cells of the same patient. The transforming gene product displayed an electrophoretic mobility in SDS-polyacrylamide gels that differed from the mobility of KRAS transforming proteins in other tumors. Thus, a previously undescribed mutation was responsible for activation of KRAS in this ovarian carcinoma. To study the role of oncogenes in lung cancer, Rodenhuis et al. (*New Eng. J. Med.* 317: 929 (1987)) used an assay based on oligonucleotide hybridization following an in vitro amplification step. Genomic DNA was examined from 39 tumor specimens obtained at thoracotomy. The KRAS gene was found to be activated by point mutations in codon 12 in 5 of 10 adenocarcinomas. Two of these tumors were less than 2 cm in size and had not metastasized. No HRAS, KRAS, or NRAS mutations were observed in 15 squamous cell carcinomas, 10 large cell carcinomas, 1 carcinoid, 2 metastatic adenocarcinomas from primary tumors outside the lung, and 1 small cell carcinoma. An approximately 20-fold amplification of the umnutated KRAS gene was observed in a tumor that proved to be a solitary lung metastasis of a rectal carcinoma. Yanez et al. (*Oncogene* 1:315 (1987)) found mutations in codon 12 of the KRAS gene in 4 of 16 colon cancers, 2 of 27 lung cancers, and 1 of 8 breast cancers; no mutations were found at position 61. Of the 6 possible amino acid replacements in codon 12, all but one were represented in the 7 mutations identified.

G. Other Oncogene Targets

The present invention is not limited to the oncogenes described above. The methods of the present invention are suitable for use with any oncogene with a known promoter region. Exemplary oncogenes included, but are not limited to, BCR/ABL, ABL1/BCR, ABL, BCL1, CD24, CDK4, EGFR/ERBB-1, HSTF1, INT1/WNT1, INT2, MDM2, MET, MYB, MYC, MYCN, MYCL1, RAFI, NRAS, REL, AKT2, APC, BCL2-ALPHA, BCL2-BETA, BCL3, BCR, BRCA1, BRCA2, CBL, CCND1, CDKN1A, CDKN1C, CDKN2A, CDKN2B, CRK, CRK-II, CSF1R/FMS, DBL, DDOST, DCC, DPC4/SMAD4, E-CAD, E2F1/RBAP, ELKI, ELK3, EPH, EPHAL, E2F1, EPHA3, ERG, ETS1, ETS2, FER, FGR, FLI1/ERGB2, FOS, FPS/FES, FRA1, FRA2, FYN, HCK, HEK, HER3/ERBB-2, ERBB-3, HER4/ERBB-4, HST2, INK4A, INK4B, JUN, JUNB, JUND, KIP2, KIT, KRAS2A, KRAS2B, LCK, LYN, MAS, MAX, MCC, MLH1, MOS, MSH2, MYBA, MYBB, NF1, NF2, P53, PDGFB, PIMI, PTC, RB1, RET, ROS1, SKI, SRC1, TAL1, TGFBR2, THRA1, THRB, TIAM1, TRK, VAV, VHL, WAF1, WNT2, WT1, YES1, ALK/NPM1, AMI1, AXL, FMS, GIP, GLI, GSP, HOX11, HST, IL3, INT2, KS3, K-SAM, LBC, LMO-1, LMO-2, L-MYC, LYL1, LYT-10, MDM-2, MLH1, MLL, MLM, N-MYC, OST, PAX-5, PMS-1, PMS-2, PRAD-1, RAF, RHOM-1, RHOM-2, SIS, TAL2, TAN1, TIAM1, TSC2, TRK, TSC1, STK11, PTCH, MEN1, MEN2, P57/KIP2, PTEN, HPC1, ATM, XPA/XPG, BCL6, DEK, AKAP13, CDH1, BLM, EWSR1/FLI1, FES, FGF3, FGF4, FGF6, FANCA, FLI1/ERGB2, FOSL1, FOSL2, GLI, HRAS1, HRX/MLLT1, HRX/MLLT2, KRAS2, MADH4, MAS1, MCF2, MLLT1/MLL, MLLT2/HRX, MTG8/RUNX1, MYCLK1, MYH11/CBFB, NFKB2, NOTCH1, NPM1/ALK, NRG/REL, NTRK1, PBX1/TCF3, PML/RARA, PRCA1, RUNX1, RUNX1/CBFA2T1, SET, TCF3/PBX1, TGFB1, TLX1, P53, WNT1, WNT2, WT1, αv-β3, PKCα, TNFα, Clusterin, Surviving, TGFβ, c-fos, c-SRC, and INT-1.

III. Non-Oncogene Targets

The present invention is not limited to the targeting of oncogenes. The methods and compositions of the present invention find use in the targeting of any gene of which it is desirable to down regulate the expression. For example, in some embodiments, the genes to be targeted include, but are not limited to, an immunoglobulin or antibody gene, a clotting factor gene, a protease, a pituitary hormone, a protease inhibitor, a growth factor, a somatomedian, a gonadotrophin, a chemotactin, a chemokine, a plasma protein, a plasma protease inhibitor, an interleukin, an interferon, a cytokine, a transcription factor, or a pathogen target (e.g., a viral gene, a bacterial gene, a microbial gene, a fungal gene).

Examples of specific genes include, but are not limited to, ADAMTS4, ADAMTS5, APOA1, APOE, APP, B2M, COX2, CRP, DDX25, DMC1, FKBP8, GH1, GHR, IAPP, IFNA1, IFNG, IL1, Il10, IL12, IL13, IL2, IL4, IL7, IL8, IPW, MAPK14, Mei1, MMP13, MYD88, NDN, PACE4, PRNP, PSEN1, PSEN2, RAD51, RAD51C, SAP, SNRPN, TLR4, TLR9, TTR, UBE3A, VLA-4, and PTP-1B, c-RAF, m-TOR, LDL, VLDL, ApoB-100, HDL, VEGF, rhPDGF-BB, NADs, ICAM-1, MUC1, 2-dG, CTL, PSGL-1, E2F, NF-kB, HIF, and GCPRs.

In other embodiments, a gene from a pathogen is targeted. Exemplary pathogens include, without limitation, Human Immunodeficiency virus, Hepatitis B virus, hepatitis C virus, hepatitis A virus, respiratory syncytial virus, pathogens involved in severe acute respiratory syndrome, west nile virus, and food borne pathogens (e.g., *E. coli*).

IV. Abbreviations

Abbreviations for lipids refer primarily to standard use in the literature and are included here as a helpful reference:

DMPC Dimyristoylphosphatidylcholine
DPPC Dipalmitoylphosphatidylcholine
DSPC Distearoylphosphatidylcholine
POPC Palmitoyl-oleoylphosphatidylcholine
OPPC 1-oleoyl-2-palmitoyl-sn-glycero-3-phosphocholine
DOPC Dioleoylphosphatidylcholine
DOPE Dioleoylphosphatidylethanolamine
DMPE Dimyristoylphosphatidylethanolamine
DPPE Dipalmitoylphosphatidylethanolamine
DOPG Dioleoylphosphatidylglycerol
POPG Palmitoyl-oleoylphosphatidylglycerol
DMPG Dimyristoylphosphatidylglycerol
DPPG Dipalmitoylphosphatidylglycerol
DLPG Dilaurylphosphatidylglycerol
DSPG Distraroylphosphatidylglycerol
DMPS Dimyristoylphosphatidylserine
DPPS Dipalmitoylphosphatidylserine
DOPS Dioleoylphosphatidylserine
POPS Palmitoyl-oleoylphosphatidylserine
DMPA Dimyristoylphosphatidic acid
DPPA Dipalmitoylphosphatidic acid
DOPA Dioleoylphosphatidic acid
POPA Palmitoyl-oleoylphosphatidic acid
DSPA Distearoylphosphatidic acid
DLPA Dilaurylphosphatidic acid
CHEMS Cholesterolhemisucinate
DC-Chol 3-β-[N—(N',N'-dimethylethane) carbamoyl] cholesterol
Cet-P Cetylphosphate
DODAP (1,2)-dioleoyloxypropyl)-N,N-dimethylammonium chloride
DOEPC 1,2-dioleoyl-sn-glycero-3-ethylphosphocholine
DAC-Chol 3-β-[N—(N,N'-dimethylethane) carbamoyl] cholesterol
TC-Chol 3-β-[N—(N',N',N'-trimethylaminoethane) carbamoyl]cholesterol
DOTMA (1,2-dioleyloxypropyl)-N,N,N-trimethylammoniumchloride) (Lipofectin®)
DOGS ((C18)$_2$GlySper3+) N,N-dioctadecylamido-glycyl-spermine (Transfectam®)
CTAB Cetyl-trimethylammoniumbromide
CPyC Cetyl-pyridiniumchloride
DOTAP (1,2-dioleoyloxypropyl)-N,N,N-trimethylammonium salt
DMTAP (1,2-dimyristoyloxypropyl)-N,N,N-trimethylammonium salt
DPTAP (1,2-dipalmitoyloxypropyl)-N,N,N-trimethylammonium salt
DOTMA (1,2-dioleyloxypropyl)-N,N,N-trimethylammoniun chloride)
DORIE (1,2-dioleyloxypropyl)-3 dimethylhydroxyethyl ammoniumbromide)
DDAB Dimethyldioctadecylammonium bromide
DPIM 4-(2,3-bis-palmitoyloxy-propyl)-1-methyl-1H-imidazole
CHIM Histaminyl-Cholesterolcarbamate
MoChol 4-(2-Aminoethyl)-Morpholino-Cholesterol-hemisuccinate
His Chol Histaminyl-Cholesterolhemisuccinate
HCChol Nα-Histidinyl-Cholesterolcarbamate
HistChol Nα-Histidinyl-Cholesterol-hemisuccinate
AC Acylcarnosine, Stearyl- & Palmitoylcarnosine
HistDG 1,2-Dipalmitoylglycerol-hemisuccinat-N_-Histidinyl-hemisuccinate, & Distearoyl-, Dimyristoyl, Dioleoyl or palmitoyl-oleoylderivatives
IsoHistSuccDG 1,2-ipalmitoylglycerol-O_-Histidinyl-Nα-hemisuccinat, & Distearoyl-, Dimyristoyl, Dioleoyl or palmitoyl-oleoylderivatives
DGSucc 1,2-Dipalmitoyglycerol-3-hemisuccinate & Distearoyl-, dimyristoyl-Dioleoyl or palmitoyl-oleoylderivatives
EDTA-Chol cholesterol ester of ethylenediaminetetraacetic acid
Hist-PS Nα-histidinyl-phosphatidylserine
BGSC bisguanidinium-spermidine-cholesterol
BGTC bisguanidinium-tren-cholesterol
DOSPER (1,3-dioleoyloxy-2-(6-carboxy-spermyl)-propylamide
DOSC (1,2-dioleoyl-3-succinyl-sn-glyceryl choline ester)
DOGSDO (1,2-dioleoyl-sn-glycero-3-succinyl-2-hydroxyethyl disulfide ornithine)
DOGSucc 1,2-Dioleoylglycerol-3-hemisucinate
POGSucc Palimtolyl-oleoylglycerol-oleoyl-3-hemisuccinate
DMGSucc 1,2-Dimyristoylglycerol-3-hemisuccinate
DPGSucc 1,2-Dipalmitoylglycerol-3-hemisuccinate The following table provides non-limiting examples of lipids that are suitable for use in the compositions in accordance with the present invention. The membrane anchors of the lipids are shown exemplarily and serve only to illustrate the lipids of the invention and are not intended to limit the same.

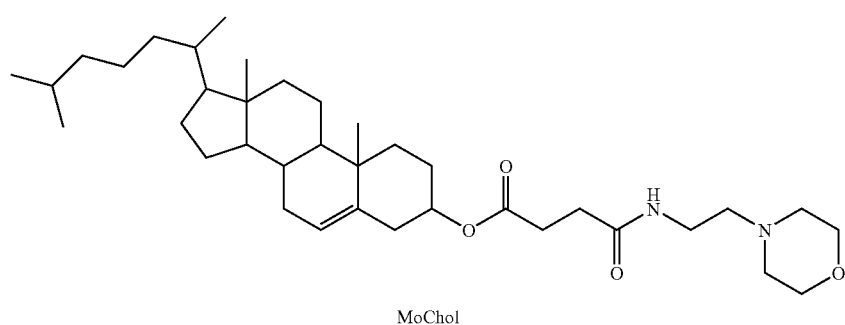
MoChol
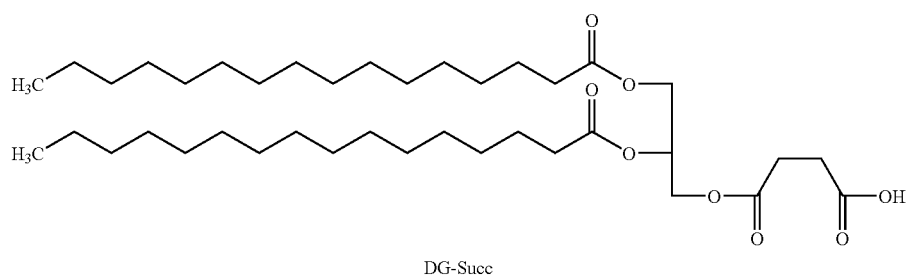
DG-Succ
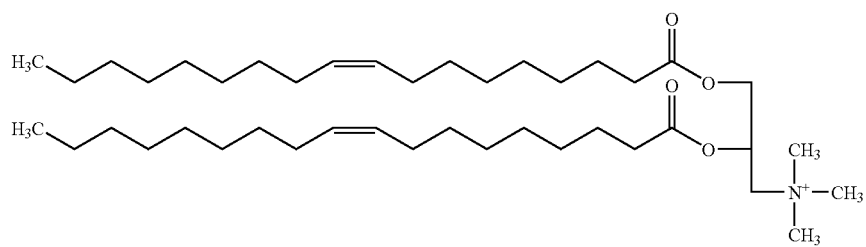
DOTAP
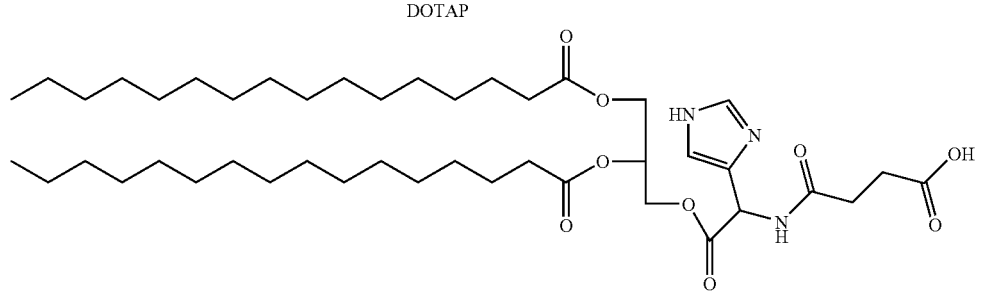
IsohistsuccDG
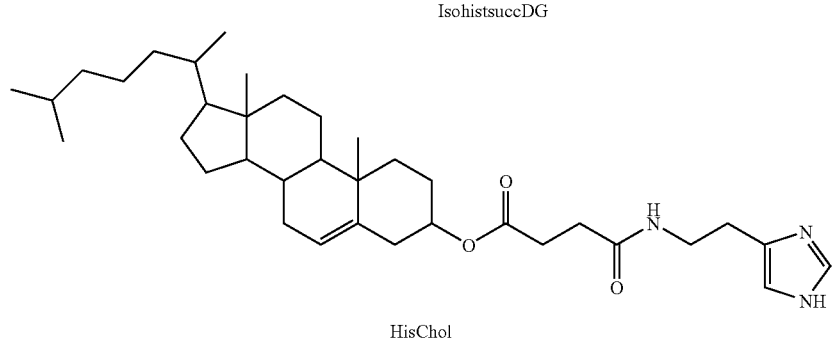
HisChol

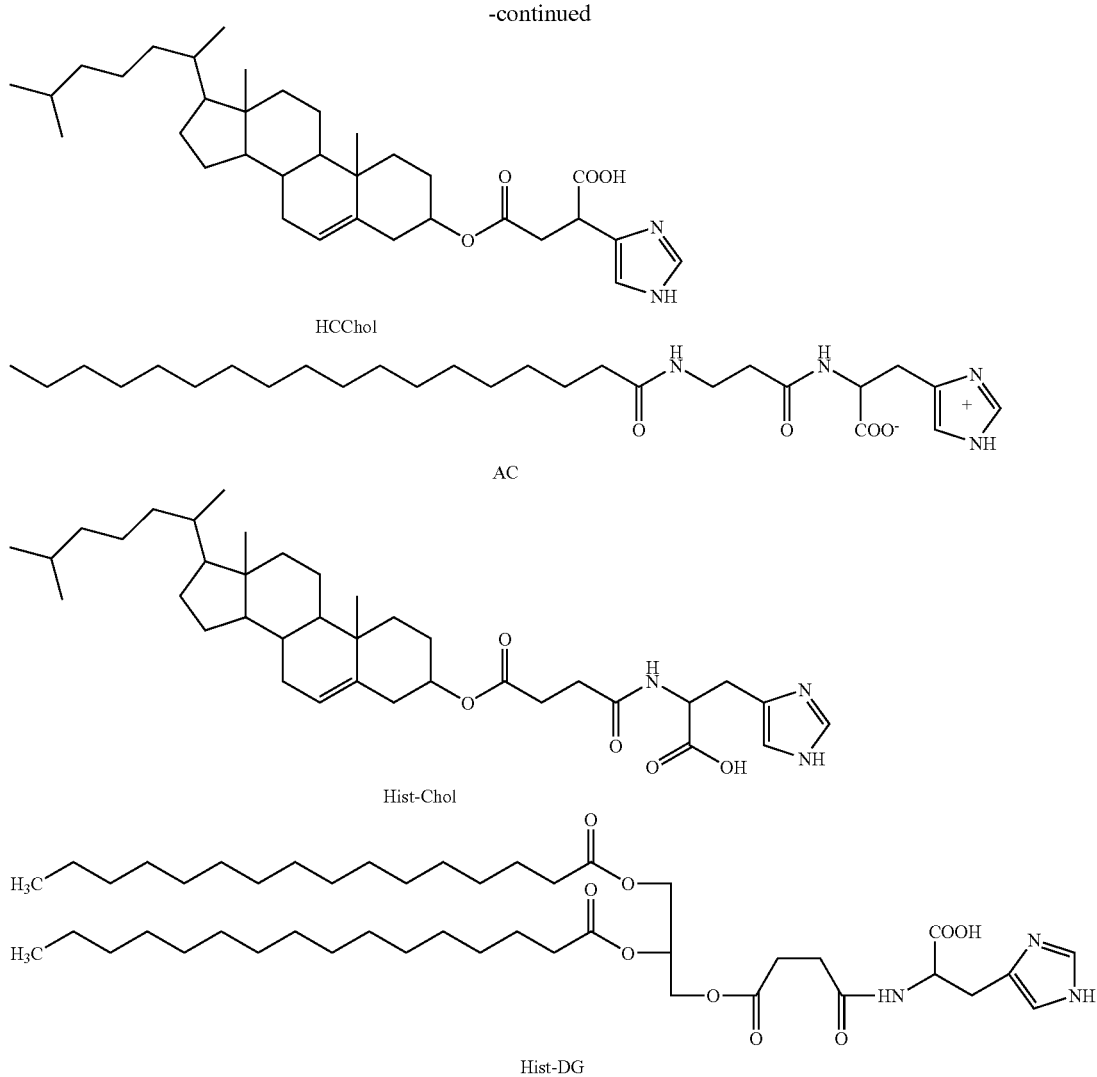

HCChol

AC

Hist-Chol

Hist-DG

V. Amphoteric Liposomal Delivery System

Amphoteric liposomes represent a recently described class of liposomes having anionic or neutral charge at about pH 7.5 and cationic charge at pH 4. PCT International Publication Numbers WO 02/066490, WO 02/066120 and WO 03/070220, each of which is incorporated by reference, give a detailed description of amphoteric liposomes and suitable lipids therefor. Using amphoteric liposomes as carriers of DNAi oligonucleotides according to the present invention, to treat cancer in cells and in mammals, such as by inhibiting and/or reducing tumor growth, requires that the liposomes be stable in the bloodstream and in tissues. Particularly, after a systemic application, the DNAI oligonucleotides must be stably sequestered in the liposomes until eventual uptake in the target tissue or cells. Accordingly, the guidelines for liposomal formulations of the FDA regulate specific preclinical tests for liposomal drugs (http://www.fda.gov/cder/guidance/2191dft.pdf). For example, the ratio of encapsulated drug to free drug must be determined during the circulation time in the blood stream.

After injection of liposomes into the blood stream, serum components interact with the liposomes and can lead to permeabilization of the liposomes. However, release of a drug or molecule that is encapsulated in a liposome depends on molecular dimensions of the drug or molecule. Consequently, a plasmid of thousands of base pairs is released much more slowly than smaller oligonucleotides or other small molecules. For liposomal delivery of drugs or molecules, it is essential that the release of the drug during circulation of the liposomes in the bloodstream be as low as possible.

The amphoteric liposomes of the mixture according to the present invention, include one or more amphoteric lipids or alternatively a mix of anionic and cationic lipid components with amphoteric properties. Suitable amphoteric lipids are disclosed in PCT International Publication Number WO02/066489 as well as in PCT International Publication Number WO03/070735, the contents of both of which are incorporated herein by reference. Alternatively, the lipid phase may be formulated using pH-responsive anionic and/or cationic components, as disclosed in PCT International Publication Number WO02/066012, the contents of which are incorporated by reference herein. Cationic lipids sensitive to pH are disclosed in PCT International Publication Numbers WO02/066490 and WO03/070220, in Budker, et al. 1996, Nat. Biotechnol. 14(6):760-4, and in U.S. Pat. No. 6,258,792 the contents of which are incorporated by reference herein, and can be used in combination with constitutively charged anionic lipids or with anionic lipids that are sensitive to pH. Conversely, the cationic charge may also be introduced from constitutively charged lipids that are known to those skilled in the art in combination with a pH sensitive anionic lipid. (See also PCT International Publication Numbers WO05/094783, WO03/070735, WO04/100928, WO06/48329, WO06/053646 and U.S. Patent applications 2003/0099697, 2005/0164963, 2004/0120997, 2006/002991, 2006/159737, 2006/0216343, each of which is also incorporated in its entirety by reference.)

The mixtures of the present invention include 1) amphoteric lipids or a mixture of lipid components with amphoteric properties 2) neutral lipids; and 3) one or more DNAi oligonucleotides as defined above.

A. Lipids used in Amphoteric Liposomes

1. Amphoteric Lipids

Amphoteric lipids are disclosed in PCT International Publication Numbers WO02/066489 and WO03/070735, the contents of both of which are incorporated herein by reference. The overall molecule assumes its pH-dependent charge characteristics by the simultaneous presence of cationic and anionic groups in the "amphoteric substance" molecule portion. More specifically, an amphoteric substance is characterized by the fact that the sum of its charge components will be precisely zero at a particular pH value. This point is referred to as isoelectric point (IP). Above the IP, the compound has a negative charge, and below the IP it is to be regarded as a positive cation, the IP of the amphoteric lipids ranging between 4.5 and 8.5.

The overall charge of the molecule at a particular pH value of the medium can be calculated as follows:

$$z = \Sigma n_i \times ((q_i - 1) + (10^{(pK-pH)}/(1+10^{(pK-pH)})))$$

$q_i$: absolute charge of the ionic group below the pK thereof (e.g. carboxyl=0, single-nitrogen base=1, di-esterified phosphate group=−1)

$n_i$: number of such groups in the molecule.

For example, a compound is formed by coupling the amino group of histidine to cholesterol hemisuccinate. At a neutral pH value of 7, the product has a negative charge because the carboxyl function which is present therein is in its fully dissociated form, and the imidazole function only has low charge. At an acid pH value of about 4, the situation is reversed: the carboxyl function now is largely discharged, while the imidazole group is essentially fully protonated, and the overall charge of the molecule therefore is positive.

In one embodiment, the amphoteric lipid is selected from the group consisting of HistChol, HistDG, isoHistSuccDG, Acylcarnosine and HCChol. In another embodiment, the amphoteric lipid is HistChol.

Amphoteric lipids can include, without limitation, derivatives of cationic lipids which include an anionic substituent. Amphoteric lipids include, without limitation, the compounds having the structure of the formula:

Z-X-W1-Y-W2-HET wherein:

Z is a sterol or an aliphatic;

Sterol is selected from the group consisting of cholesterol, sitosterol, campesterol, desmosterol, fucosterol, 22-ketosterol, 20-hydroxysterol, sigmasterol, 22-hydroxycholesterol, 25 hydroxycholesterol, lanosterol, 7-dehydrocholesteril, dihydrocholesterol, 19-hydroxycholesterol, 5αcholest-7-en-3β-ol, 7-hydroxycholesterol, epicholesterol, ergosterol delhydroergosterol, and derivatives thereof;

Each W1 is independently an unsubstituted aliphatic;

Each W2 is independently an aliphatic optionally substituted with HO(O)C-aliphatic-amino or carboxy;

Each X and Y is independently absent, —(C=O)—O—, —(C=O)—NH—, —(C=O)—S—, —O—, —NH—, —S—, —CH=N—, —O—(O=C)—, —S—(O=C)—, —NH—(O=C)—, and —N=CH—; and HET is an amino, an optionally substituted heterocycloaliphatic or an optionally substituted heteroaryl.

In some aspects, the HET is an optionally substituted heterocycloaliphatic including at least one nitrogen ring atom, or an optionally substituted heteroaryl including at least one nitrogen ring atom. In other aspects, the HET is morpholinyl, piperidinyl, piperazinlyl, pyrimidinyl, or pyridinyl. In another aspect, the cationic lipid has the structure Sterol-X-spacer1-Y-spacer2-morpholinyl or Sterol-X-spacer1-Y-spacer2-imidazolyl. In still further aspects, the sterol is cholesterol.

In other embodiments, amphoteric lipids include, without limitation, the compounds having the structure of the formula:

Z-X-W1-Y-W2-HET wherein:

Z is a structure according to the general formula $$\begin{array}{l} R_1 - O - CH_2 \\ \phantom{R_1 - O -} | \\ R_2 - O - CH \\ \phantom{R_2 - O - CH} | \\ \phantom{R_2 - O - CH - } M-, \end{array}$$

wherein R1 and R2 are independently C8-C30 alkyl or acyl chains with 0.1. pr 2 etju;emoca;;u imsatirated bpmds amd M is selected from the group consisting of —O—(C=O); —NH—(C=O)—; —S—(C=O)—; —O—; —NH—; —S—; —N=CH—; —(O=C)—O—; —S—(O=C)—; —NH—(O=C)—; —N=CH— and/or —S—S—;

Sterol is selected from the group consisting of cholesterol, sitosterol, campesterol, desmosterol, fucosterol, 22-ketosterol, 20-hydroxysterol, sigmasterol, 22-hydroxycholesterol, 25 hydroxycholesterol, lanosterol, 7-dehydrocholesteril, dihydrocholesterol, 19-hydroxycholesterol, 5αcholest-7-en-3β-ol, 7-hydroxycholesterol, epicholesterol, ergosterol dehydroergosterol, and derivatives thereof;

Each W1 is independently an unsubstituted aliphatic with up to 8 carbon atoms;

Each W2 is independently an aliphatic, carboxylic acid with up to 8 carbon atoms and 0, 1, or 2 ethylenically unsaturated bonds;

X is absent and Y is —(C=O)—O—; —(C=O)—NH—; —NH—(C=O)—O—; —O—; —NH—; —CH=N—; —O—(O=C)—; —S—; —(O=C)—; —NH—(O=C)—; —O—(O=C)—NH—, —N=CH— and/or —S—S—; and HET is an amino, an optionally substituted heterocycloaliphatic or an optionally substituted heteroaryl.

In some aspects, the HET is an optionally substituted heterocycloaliphatic including at least one nitrogen ring atom, or an optionally substituted heteroaryl including at least one nitrogen ring atom. In other aspects, the HET is morpholinyl, piperidinyl, piperazinlyl, pyrimidinyl, or pyridinyl. In another aspect, the cationic lipid has the structure Sterol-X-spacer1-Y-spacer2-morpholinyl or Sterol-X-spacer1-Y-spacer2-imidazolyl. In still further aspects, the sterol is cholesterol.

2. Mixtures of Lipid Components with Amphoteric Properties

Alternatively, the lipid phase can be formulated using pH-responsive anionic and/or cationic components, as disclosed in PCT International Publication Number WO02/066012, the contents of which are incorporated by reference herein. Cationic lipids sensitive to pH are disclosed in PCT International Publication Numbers WO02/066490 and WO03/070220, in Budker, et al. (1996), Nat. Biotechnol. 14(6):760-4, and in U.S. Pat. No. 6,258,792, the contents of all of which are incorporated by reference herein. Alternatively, the cationic charge may be introduced from constitutively charged lipids known to those skilled in the art in combination with a pH sensitive anionic lipid. Combinations of constitutively (e.g., stable charge over a specific pH range such as a pH between about 4 and 9) charged anionic and cationic lipids, e.g. DOTAP and DPPG are not preferred. Thus, in some embodiments, the mixture of lipid components may comprise (i) a stable cationic lipid and a chargeable anionic lipid, (ii) a chargeable cationic lipid and chargeable anionic lipid or (iii) a stable anionic lipid and a chargeable cationic lipid.

The charged groups can be divided into the following 4 groups.

(1) Strongly (e.g., constitutively charged) cationic, pKa>9, net positive charge: on the basis of their chemical nature, these are, for example, ammonium, amidinium, guanidium or pyridinium groups or timely, secondary or tertiary amino functions.

(2) Weakly cationic, pKa<9, net positive charge: on the basis of their chemical nature, these are, in particular, nitrogen bases such as piperazines, imidazoles and morpholines, purines or pyrimidines. Such molecular fragments, which occur in biological systems, are, for example, 4-imidazoles (histamine), 2-, 6-, or 9-purines (adenines, guanines, adenosines or guanosines), 1-, 2- or 4-pyrimidines (uracils, thymines, cytosines, uridines, thymidines, cytidines) or also pyridine-3-carboxylic acids (nicotinic esters or amides).

Nitrogen bases with preferred pKa values are also formed by substituting nitrogen atoms one or more times with low molecular weight alkane hydroxyls, such as hydroxymethyl or hydroxyethyl groups. For example, aminodihydroxypropanes, triethanolamines, tris-(hydroxymethyl)methylamines, bis-(hydroxymethyl)methylamines, tris-(hydroxyethyl)methylamines, bis-(hydroxyethyl)methylamines or the corresponding substituted ethylamines.

(3) Weakly anionic, pKa>4, net negative charge: on the basis of their chemical nature, these are, in particular, the carboxylic acids. These include the aliphatic, linear or branched mono-, di- or tricarboxylic acids with up to 12 carbon atoms and 0, 1 or 2 ethylenically unsaturated bonds. Carboxylic acids of suitable behavior are also found as substitutes of aromatic systems. Other weakly anionic groups are hydroxyls or thiols, which can dissociate and occur in ascorbic acid, N-substituted alloxane, N-substituted barbituric acid, veronal, phenol or as a thiol group.

(4) Strongly (e.g., constitutively charged) anionic, pKa<4, net negative charge: on the basis of their chemical nature, these are functional groups such as sulfonate or phosphate esters.

The amphoteric liposomes contain variable amounts of such membrane-forming or membrane-based amphiphilic materials, so that they have an amphoteric character. This means that the liposomes can change the sign of the charge completely. The amount of charge carrier of a liposome, present at a given pH of the medium, can be calculated using the following formula:

$$z = \Sigma n i ((q i-1) + 10^{(pK-pH)}/(1+10^{(pK-pH)}))$$

in which qi is the absolute charge of the individual ionic groups below their pK (for example, carboxyl=0, simple nitrogen base=1, phosphate group of the second dissociation step=−1, etc.)

ni is the number of these groups in the liposome.

At the isoelectric point, the net charge of the liposome is 0, Structures with a largely selectable isoelectric point can be produced by mixing anionic and cationic portions.

In one embodiment, cationic components include DPIM, CHIM, DORIE, DDAB, DAC-Chol, TC-Chol, DOTMA, DOGS, (C18)$_2$Gly$^+$N,N-dioctadecylamido-glycine, CTAB, CPyC, DODAP DMTAP, DPTAP, DOTAP, DC-Chol, MoChol, H is Chol and DOEPC. In another embodiment, cationic lipids include DMTAP, DPTAP, DOTAP, DC-Chol, MoChol and His Chol.

pH sensitive cationic lipids are disclosed in PCT International Publication Numbers WO 02/066490 as well as in and WO 03/070220, the contents of both of which are incorporated herein by reference.

pH sensitive cationic lipids can be compounds having the structure of the formula

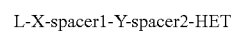

L-X-spacer1-Y-spacer2-HET wherein:

L is a sterol or [aliphatic(C(O)O)—]$_2$alkyl-;

Sterol is selected from the group consisting of cholesterol, sitosterol, campesterol, desmosterol, fucosterol, 22-ketosterol, 20-hydroxysterol, sigmasterol, 22-hydroxycholesterol, 25 hydroxycholesterol, lanosterol, 7-dehydrocholesteril, dihydrocholesterol, 19-hydroxycholesterol, 5αcholest-7-en-3β-ol, 7-hydroxycholesterol, epicholesterol, ergosterol dehydroergosterol, and derivatives thereof;

Each spacer 1 and spacer 2 is independently an unsubstituted aliphatic;

Each X and Y is independently absent, —(C=O)—O—, —(C=O)—NH—, —(C=O)—S—, —O—, —NH—, —S—, —CH=N—, —O—(O=C)—, —S—(O=C)—, —NH—(O=C)—, =CH—, —CH$_2$—, =N—O—. =N—NH—, =N—NH—(C=O)—, NH—SO$_2$—, S(O)$_n$—, S(O)$_2$—NH— or —N=CH—; and HET is an amino, an optionally substituted heterocycloaliphatic or an optionally substituted heteroaryl.

In some aspects, the HET is an optionally substituted heterocycloaliphatic including at least one nitrogen ring atom, or an optionally substituted heteroaryl including at least one nitrogen ring atom. In other aspects, the HET is morpholinyl, piperidinyl, piperazinlyl, pyrimidinyl or pyridinyl. In another aspect, the cationic lipid has the structure Sterol-X-spacer1-Y-spacer2-morpholinyl or Sterol-X-spacer1-Y-spacer2-imidazolyl. In still further aspects, the sterol is cholesterol.

In one embodiment, X is —O—, Spacer 1 and Spacer 2 are (CH$_2$)$_2$, Y is —(C=O)—NH—, and HET is morpholinyl. In another embodiment, X is =CH—, Spacer 1 and Spacer 2 are (CH$_2$)$_2$, Y is —(C=O)—NH—, and HET is morpholinyl. In yet another embodiment, X is —CH$_2$-Spacer 1 and Spacer 2 are (CH$_2$)$_2$, Y is —(C=O)—NH—, and HET is morpholinyl. In still another embodiment, X is =N—O—, Spacer 1 is —CH$_2$—, Y is —(C=O)—NH—, Spacer 2 is (CH$_2$)$_2$ HET is morpholinyl. In still yet another embodiment, X is =N—NH—, Spacer 1 is —CH$_2$—, Y is is —(C=O)—NH—, Spacer 2 is (CH$_2$)$_2$ and HET is morpholinyl. In a further embodiment, X is =N—NH—(C=O)—, Spacer 1 is —CH$_2$—, Y is —(C=O)—NH—, Spacer 2 is (CH$_2$)$_2$ and HET is morpholinyl. In still a further embodiment, X is —NH—(C=O)—, Spacer 1 is —CH$_2$—, Y is —(C=O)—NH—, Spacer 2 is (CH$_2$)$_2$ and HET is morpholinyl. In an even further embodiment, X is —NH—, Spacer 1 and Spacer 2 are (CH$_2$)$_2$, Y is —(C=O)—NH—, and HET is morpholinyl. In another embodiment, X is —NH—(SO$_2$)$_n$—, Spacer 1 is —CH$_2$—, Y is —(C=O)—NH—, Spacer 2 is (CH$_2$)$_2$ and HET is morpholinyl, wherein n is 1 or 2. In yet another embodiment, X is —S(O$_2$)—NH—, Spacer 1 is —CH$_2$—, Y is —(C=O)—NH—, Spacer 2 is (CH$_2$)$_2$ and HET is morpholinyl. The above compounds can be synthesized using syntheses of 1 or more steps, and can be prepared by one skilled in the art.

In another embodiment, pH sensitive cationic lipids can be compounds having the structure of the formula L-X-spacer1-Y-spacer2-HET wherein:
L is a structure according to the general formula

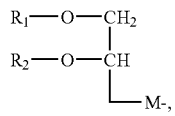

wherein R1 and R2 are independently C8-C30 alkyl or acyl chains with 0, 1 or 2 ethylenically unsaturated bonds and M is absent, —O—(C=O); —NH—(C=O)—; —S—(C=O)—; —O—; —NH—; —S—; —N=CH—; —(O=C)—O—; —S—(O=C)—; —NH—(O=C)—; —N=CH— and/or —S—S—;

Sterol is selected from the group consisting of cholesterol, sitosterol, campesterol, desmosterol, fucosterol, 22-ketosterol, 20-hydroxysterol, sigmasterol, 22-hydroxycholesterol, 25 hydroxycholesterol, lanosterol, 7-dehydrocholesterol, dihydrocholesterol, 19-hydroxycholesterol, 5αcholest-7-en-3β-ol, 7-hydroxycholesterol, epicholesterol, ergosterol dehydroergosterol, and derivatives thereof;

Each spacer 1 and spacer 2 is independently an unsubstituted aliphatic with 1-8 carbon atoms;

X is absent and Y is absent, —(C=O)—O—; —(C=O)—NH—; —NH—(C=O)—O—; —O—; —NH—; —CH=N—; —O—(O=C)—; —S—; —(O=C)—; —NH—(O=C)—; —O—(O=C)—NH—, —N=CH— and/or —S—S—; and HET is an amino, an optionally substituted heterocycloaliphatic or an optionally substituted heteroaryl.

In some aspects, the HET is an optionally substituted heterocycloaliphatic including at least one nitrogen ring atom, or an optionally substituted heteroaryl including at least one nitrogen ring atom. In other aspects, the HET is morpholinyl, piperidinyl, piperazinlyl, pyrimidinyl or pyridinyl. In another aspect, the cationic lipid has the structure Sterol-X-spacer1-Y-spacer2-morpholinyl or Sterol-X-spacer1-Y-spacer2-imidazolyl. In still further aspects, the sterol is cholesterol.

The amphoteric mixtures further comprise anionic lipids, either constitutively or conditionally charged in response to pH, and such lipids are also known to those skilled in the art. In one embodiment, lipids for use with the invention include DOGSucc, POGSucc, DMGSucc, DPGSucc, DMPS, DPPS, DOPS, POPS, DMPG, DPPG, DOPG, POPG, DMPA, DPPA, DOPA, POPA, CHEMS, CetylP, DGSucc, and combinations thereof.

3. Neutral lipids

Neutral lipids include any lipid that remains neutrally charged at a pH between about 4 and 9. Neutral lipids include, without limitation, cholesterol, other sterols and derivatives thereof, phospholipids, and combinations thereof and other neutral lipids. The phospholipids include any one phospholipid or combination of phospholipids capable of forming liposomes. They include phosphatidylcholines, phosphatidylethanolamines, lecithin and fractions thereof, phosphatidic acid, phosphatidylglycerols, phosphatidylinositols, phosphatidylserines, plasmalogens and sphingomyelins. The phosphatidylcholines include, without limitation, those obtained from egg, soy beans or other plant sources or those that are partially or wholly synthetic or of variable lipid chain length and unsaturation, POPC, OPPC, natural or hydrogenated soy bean PC, natural or hydrogenated egg PC, DMPC, DPPC, DSPC, DOPC and derivatives thereof. In one embodiment, phosphatidylcholines are POPC, non-hydrogenated soy bean PC and non-hydrogenated egg PC. Phosphatidylethanolamines include, without limitation, DOPE, DMPE and DPPE and derivatives thereof. Phosphatidylglycerols include, without limitation, DMPG, DLPG, DPPG, and DSPG., Phosphatidic acids include, without limitation, DSPA, DMPA, DLPA and DPPA.

Sterols include cholesterol derivatives such as 3-hydroxy-5,6-cholestene and related analogs, such as 3-amino-5,6-cholestene and 5,6-cholestene, cholestane, cholestanol and related analogs, such as 3-hydroxy-cholestane; and charged cholesterol derivatives such as cholesteryl-beta-alanine and cholesterol hemisuccinate.

Other neutral lipids include α-tocopherols and derivatives, such as α-tocopherol acetate.

In another embodiment neutral lipids include without limitation, DOPE, POPC, soy bean PC or egg PC and cholesterol.

B. DNAi Oligonucleotides

1. Regulatory Regions of the bcl-2 Gene

The bcl-2 gene has two promoters designated P1 and P2. P1 from which most bcl-2 mRNA is transcribed is located approximately 1.4 kb upstream of the translation initiation site and P2 is 1.3 kb downstream of P1. (See Seto, M. et al. *EMBO J.* 7, 123-131 (1988).) P1 is GC-rich, lacks a TATA box, has many transcription start sites and includes seven consensus binding sites for the SP1 transcription factor. P2 includes a CCAAT box and a TATA box and has two different transcription initiation sites. There are multiple NF-KB recognition sites and an SV40 enhancer-like octamer motif within P2. (See Heckman, C. A., et al. *Oncogene* 21, 3898-3908 (2002).) (See SEQ ID NO:1254). Most human follicular lymphomas contain t(14; 18) chromosomal translocations that result from 3'-bcl-2 gene region breakpoints. (See Tsujimoto, Y. et al. *Proc. Natl. Acad. Sci. U.S.A* 84, 1329-1331 (1987).) These translocations place bcl-2 expression under control of the immunoglobulin heavy chain (IgH) locus enhancer resulting in upregulation of bcl-2 expression. Alternatively, there are 5'-bcl-2 breakpoint regions that result from fusions with either the IgH locus or two different immunoglobulin light chain (IgL) loci that are found in some DLCL lymphoma patient isolates. (See Yonetani, N. et al. *Jpn. J. Cancer Res.* 92, 933-940 (2001).) These 5'-bcl-2 breakpoints have been mapped in separate heterogeneous patient isolates to a region spanning 378 to 2312 bp upstream of the translation initiation site. (See SEQ ID NOs:1255-1266.) Regions around the breakpoints may be sequences that can be used for bcl-2 DNAi oligonucleotide design.

The upstream regions of TGF-α, c-ki-ras, c-myc, c-erb-2 (Her-2), and c-Ha-ras can also be investigated to find regions to which DNAi oligonucleotides could bind based on preferred design criteria.

2. DNAi Oligonucleotide Design

The DNAi oligonucleotides, in some embodiments, are DNA oligomers that are complementary to either the plus strand or minus strand of double stranded DNA. The DNAi oligonucleotide may hybridize to regulatory regions of the c-ki-ras, c-Ha-ras, c-myc, her-2, TGF-α, or bcl-2 gene. For the purposes of this invention, those upstream regions are defined as SEQ ID NO:1 (for her-2, or c-erb-2), SEQ ID NO:282 (for c-ki-ras), SEQ ID NO:462 (for c-Ha-ras), SEQ ID NO:936 (for c-myc), SEQ ID NO:1081 (for TGF-a) and SEQ ID NOs: 1249 and 1254 (for bcl-2), provided that the DNAi oligonucleotide is a single stranded nucleic acid oligonucleotide or derivative thereof, whose sequence is complementary, in part, to a portion of the longest non-transcribed region of a gene in which the oligonucleotide affects indirectly or directly the expression, regulation or production of the same or different gene, wherein the longest non-transcribed region includes any portion of the gene that is not transcribed when the transcriptional start site is the site closest to the translation start site. DNAi oligonucleotides do not include RNAi and antisense oligonucleotides that base pair only with mRNAs or pre-mRNAs and interfere with RNA processing and/or message translation.

In some embodiments, the DNAi oligonucleotides may be designed based on certain design criteria. Such DNAi oligonucleotides can then be tested for efficacy using the methods disclosed herein. For example, in some embodiments, the DNAi oligonucleotides are methylated on at least one, two or all of the CpG islands. In other embodiments, the DNAi oligonucleotides contain no methylation. The present invention is not limited to a particular mechanism. Indeed, an understanding of the mechanism is not necessary to practice the present invention. Nonetheless, it is contemplated that DNAi oligonucleotides in some embodiments are those that have at least a 50% GC content and at least two GC dinucleotides. Also, in some embodiments, the DNAi oligonucleotides do not self hybridize. In further embodiments, the DNAi oligonucleotides are designed with at least 1 A or T to minimize self hybridization. In yet further embodiments, commercially available computer programs are used to survey the DNAi oligonucleotides for the ability to self hybridize. In still other embodiments, the DNAi oligonucleotides are at least 10, or 15 nucleotides and no more than 100 nucleotides in length. In further embodiments, DNAi oligonucleotides are 18-26 nucleotides in length. In some embodiments, DNAi oligonucleotides comprise the universal protein binding sequences CGCCC and CGCG or the complements thereof.

In some embodiments, the DNAi oligonucleotides hybridize to a regulatory region of a gene upstream from the TATA box of the promoter. In further embodiments, DNAi oligonucleotides are designed to hybridize to regulatory regions of an oncogene known to be bound by proteins (e.g., transcription factors). In some embodiments, the DNAi oligonucleotide compounds are not completely homologous to other regions of the human genome. The homology of the DNAi oligonucleotides to other regions of the genome can be determined using available search tools (e.g., BLAST, available at the internet site of NCBI).

The present invention is not limited to the specific DNAi oligonucleotide sequences described herein. Other suitable DNAi oligonucleotides may be identified (e.g., using the criteria described above or other criteria). Candidate DNAi oligonucleotides may be tested for efficacy using any suitable method. For example, candidate DNAi oligonucleotides can be evaluated for their ability to prevent cell proliferation at a variety of concentrations. In some embodiments, DNAi oligonucleotides inhibit gene expression or cell proliferation at a low concentration (e.g., less that 20 µM, or 10 µM in in vitro assays.).

3. DNAi Oligonucleotide Zones

In some embodiments, regions within the regulatory regions of the oncogenes are further defined as regions for hybridization of DNAi oligonucleotides. In some embodiments, these regions are referred to as "hot zones."

In some embodiments, hot zones are defined based on DNAi oligonucleotide compounds that are demonstrated to be effective (see above section on DNAi oligonucleotides) and those that are contemplated to be effective based on the criteria for DNAi oligonucleotides described above. In further embodiments, hot zones encompass 10 bp upstream and downstream of each compound included in each hot zone and have at least one CG or more within an increment of 40 bp further upstream or downstream of each compound. In yet further embodiments, hot zones encompass a maximum of 100 bp upstream and downstream of each oligonucleotide compound included in the hot zone. In additional embodiments, hot zones are defined at beginning regions of each promoter. These hot zones are defined either based on effective sequence(s) or contemplated sequences and have a preferred maximum length of 200 bp. Based on the above described criteria, exemplary hot zones were designed. These hot zones are shown in Table 1.

TABLE 1

Exemplary Hot Zones

| Gene | Hot Zones |
| --- | --- |
| Bcl-2 | 679-720, 930-1050, 1070-1280, 1420-1760 |
| c-erbB-2 | 205-344, 382-435 |
| c-K-ras | 1-289, 432-658 |
| c-Ha-ras | 21-220, 233-860, 1411-1530, 1631-1722 |
| c-myc | 3-124, 165-629 |
| TGF-α | 1-90, 175-219, 261-367, 431-930, 964-1237 |

4. DNAi Oligomers

In one aspect, the DNAi oligonucleotides can be any DNAi oligomer that hybridizes under physiological conditions to the following sequences: SEQ ID NO:1, SEQ ID NO:282, SEQ ID NO:462, SEQ ID NO:936, SEQ ID NO:1081, SEQ ID NOs:1249 and/or 1254. In another aspect, the DNAi oligonucleotides can be any DNAi oligomer that hybridizes under physiological conditions to exemplary hot zones in SEQ ID NO:1, SEQ ID NO:282, SEQ ID NO:462, SEQ ID NO:936, SEQ ID NO:1081 and SEQ ID NO:1249. Examples of DNai oligomers include, without limitation, those DNAi oligomers listed in SEQ ID NOs 2-281, 283-461, 463-935, 937-1080, 1082-1248, 1250-1253 and 1267-1447 and the complements thereof. In another aspect, the DNAi oligonucleotides are SEQ ID NOs 2-22, 283-301, 463-503, 937-958, 1082-1109, 1250-1254 and 1270-1447 and the complements thereof. In an embodiment of these aspects, the DNAi oligonucleotides are from 15-35 base pairs in length.

For the bcl-2 gene, the DNAi oligomers can include any DNAi oligomer that hybridizes to SEQ ID NOs: 1249 or 1254. In another aspect, the DNAi oligomer can be any oligomer that hybridizes to nucleotides 500-2026, nucleotides 500-1525, nucleotides 800-1225, nucleotides 900-1125, nucleotides 950-1075 or nucleotides 970-1045 of SEQ ID NO:1249 or the complement thereof. In another aspect, the DNAi oligonucleotides can be any DNAi oligomer that hybridizes under physiological conditions to exemplary hot zones in SEQ ID NO:1249. Examples of DNAi oligomers include, without limitation, those DNai oligomers listed in SEQ ID NOs 1250-1253 and 1267-1447 and the complements thereof. In an embodiment of these aspects, the DNAi oligonucleotides are from 15-35 base pairs in length.

In another embodiment, the DNAi oligomer can be SEQ ID NO:1250, 1251, 1252, 1253, 1267-1447 or the complement thereof. In yet another embodiment, the DNAi oligomer can be SEQ ID NO:1250, 1251, 1267, 1268, 1276, 1277, 1285, 1286 or the complement thereof. In still another embodiment, the DNAi oligomer can be SEQ ID NOs 1250, 1251, 1289-1358 or the complements thereof. In an additional embodiment the DNAi oligomer can be SEQ ID NO:1250 or 1251.

In a further embodiment of these aspects, the DNAi oligomer has the sequence of the positive strand of the bcl-2 sequence, and thus, binds to the negative strand of the sequence.

In other aspects, the DNAi oligomers can include mixtures of DNAi oligonucleotides. For instance, the DNAi oligomer can include multiple DNAi oligonucleotides, each of which hybridizes to different parts of SEQ ID NOs 1249 and 1254. DNAi oligomers can hybridize to overlapping regions on those sequences or the DNAi oligomers may hybridize to non-overlapping regions. In other embodiments, DNAi oligomers can be SEQ ID NOs 1250, 1251, 1252, 1253, 1267-1447 or the complement thereof, wherein the mixture of DNAi oligomers comprises DNAi oligomers of at least 2 different sequences.

In other embodiments, the DNAi oligomer can include a mixture of DNAi oligomers, each of which hybridizes to a regulatory region of different genes. For instance, the DNAi oligomer can include a first DNAi oligomer that hybridizes to SEQ ID NO:1249 or 1254 and a second DNAi oligomer that hybridizes to a regulatory region of a second gene. In some embodiments, the DNAi oligomer includes a DNAi oligomer of SEQ ID NOs 1250-1254 or 1267-1447 or the complements thereof, and a DNAi oligomer that hybridizes to SEQ ID NO:1, SEQ ID NO:282, SEQ ID NO:462, SEQ ID NO:936, or SEQ ID NO:1081 or the complement thereof. In other embodiments, the DNAi oligomer includes SEQ ID NO 1250 or 1251 or the complement thereof and a DNAi oligomer that hybridizes to SEQ ID NO:1, SEQ ID NO:282, SEQ ID NO:462, SEQ ID NO:936, or SEQ ID NO:1081 or the complement thereof. In yet other embodiments, the DNAi oligomer includes SEQ ID NO:1250 or 1251 or the complement thereof and any of SEQ ID NOs 2-281, 283-461, 463-935, 937-1080 and 1082-1248, or the complement thereof.

In some embodiments, the present invention provides DNAi oligonucleotide therapeutics that are methylated at specific sites. The present invention is not limited to a particular mechanism. Indeed, an understanding of the mechanism is not necessary to practice the present invention. Nonetheless, it is contemplated that one mechanism for the regulation of gene activity is methylation of cytosine residues in DNA. 5-methylcytosine (5-MeC) is the only naturally occurring modified base detected in DNA (Ehrlick et al., Science 212:1350-1357 (1981)). Although not all genes are regulated by methylation, hypomethylation at specific sites or in specific regions in a number of genes is correlated with active transcription (Doerfler, Ann. Rev. Biochem. 52:93-124 [1984]; Christman, Curr. Top. Microbiol. Immunol. 108:49-78 [1988]; Cedar, Cell 34:5503-5513 [1988]). DNA methylation in vitro can prevent efficient transcription of genes in a cell-free system or transient expression of transfected genes. Methylation of C residues in some specific cis-regulatory regions can also block or enhance binding of transcriptional factors or repressors (Doerfler, supra; Christman, supra; Cedar, Cell 34:5503-5513 (1988); Tate et al., Curr. Opin. Genet. Dev. 3:225-231 [1993]; Christman et al., Virus Strategies, eds. Doerfler, W. & Bohm, P. (VCH, Weinheim, N.Y.) pp. 319-333 [1993]).

Disruption of normal patterns of DNA methylation has been linked to the development of cancer (Christman et al., Proc. Natl. Acad. Sci. USA 92:7347-7351 [1995]). The 5-MeC content of DNA from tumors and tumor derived cell lines is generally lower than normal tissues (Jones et al., Adv. Cancer Res 40:1-30 [1983]). Hypomethylation of specific oncogenes such as c-myc, c-Ki-ras and c-Ha-ras has been detected in a variety of human and animal tumors (Nambu et al., Jpn. J. Cancer (Gann) 78:696-704 [1987]; Feinberg et al., Biochem. Biophys. Res. Commun. 111:47-54 [1983]; Cheah et al., JNCI73:1057-1063 [1984]; Bhave et al., Carcinogenesis (Lond) 9:343-348 [1988]. In one of the best studied examples of human tumor progression, it has been shown that hypomethylation of DNA is an early event in development of colon cancer (Goetz et al., Science 228:187-290 [1985]). Interference with methylation in vivo can lead to tumor formation. Feeding of methylation inhibitors such as L-methionine or 5-azacytidine or severe deficiency of 5-adenosine methionine through feeding of a diet depleted of lipotropes has been reported to induce formation of liver tumors in rats (Wainfan et al., Cancer Res. 52:2071s-2077s [1992]). Studies show that extreme lipotrope deficient diets can cause loss of methyl groups at specific sites in genes such as c-myc, ras and c-fos (Dizik et al., Carcinogenesis 12:1307-1312 [1991]). Hypomethylation occurs despite the presence of elevated levels of DNA MTase activity (Wainfan et al., Cancer Res. 49:4094-4097 [1989]). Genes required for sustained active proliferation become inactive as methylated during differentiation and tissue specific genes become hypomethylated and are active. Hypomethylation can then shift the balance between the two states. In some embodiments, taking advantage of this naturally occurring phenomena, the mixture of the present invention may be adapted for site specific methylation of specific gene promoters, thereby preventing transcription and hence translation of certain genes. In other embodiments, the mixture of the present invention may be adapted for upregulating the expression of a gene of interest (e.g., a tumor suppressor gene) by altering the gene's methylation patterns.

The present invention is not limited to the use of methylated DNAi oligonucleotides. Indeed, the use of non-methylated DNAi oligonucleotides for the inhibition of gene expression is specifically contemplated by the present invention.

The DNAi oligonucleotides can be in a naturally occurring state, and can also contain modifications or substitutions in the nucleobases, the sugar moiety and/or in the internucleoside linkage.

Nucleobases comprise naturally occurring nucleobases as well as non-naturally occurring nucleobases. Illustrative examples of such nucleobases include without limitation adenine, cytosine, 5-methylcytosine, isocytosine, pseudoisocytosine, guanine, thymine, uracil, 5-bromouracil, 5-propynyluracil, 5-propynylcytosine, 5-propyny-6-fluoroluracil, 5-methylthiazoleuracil, 6-aminopurine, 2-aminopurine, inosine, diaminopurine, 7-deazaguanine, 7-deazaadenine, 3-deazaguanine, 3-deazaadenine, 8-azaguanine, 8-azaadenine, 7-propyne-7-deazaadenine, 7-propyne-7-deazaguanine, 2-chloro-6-aminopurine, 4-acetylcytosine, 5-hydroxymethylcytosine, 8-hydroxy-N6-methyladenosine, aziridinylcytosine, 5-(carboxyhydroxyl-methyl) uracil, 5-fluorouracil, 5-carboxymethylaminomethyl-2-thiouracil, 5-carboxymethylaminomethyluracil, dihydrouracil, N6-isopentenyladenine, 1-methyladenine, 1-methylpseudouracil, 1-methylguanine, 1-methylinosine, 2,2-dimethylguanine, 2-methyladenine, 2-methylguanine, 3-methylcytosine, N6-methyladenine, 7-methylguanine and other alkyl derivatives of adenine and guanine, 2-propyl adenine and other alkyl derivatives of adenine and guanine, 2-aminoadenine, 5-methylaminomethyluracil, 5-methoxyaminomethyl-2-thiouracil, beta-D-mannosylqueosine, 5'-methoxycarbonylmethyluracil, 5-methoxyuracil, 2-methylthio-N6-isopentenyladenine, uracil-5-oxyacetic acid methylester, uracil-5-oxyacetic acid, oxybutoxosine, pseudouracil, queosine, 2-thiocytosine, 2-thiothymine, 5-halouracil, 5-halocytosine, 6-azo uracil, cytosine and thymine, 5-methyl-2-thiouracil, 2-thiouracil, 4-thiouracil, 5-methyluracil, 8-halo, 8-amino, 8-thiol, 8-hydroxyl and other 8-substituted adenines and guanines, 5-trifluoromethyl uracil and cytosine, N-uracil-5-oxyacetic acid methylester, uracil-5-oxyacetic acid, queosine, xanthine, hypoxanthine, 2-thiocytosine, 2,6-diaminopurine, 5-substituted pyrimidines, 6-azapyrimidines and N-2, N-6 and O-6 substituted purines, including 2-aminopropyladenine, 5-propynyluracil and 5-propynylcytosine.

The DNAi oligonucleotides can also have sugars other than ribose and deoxy ribose, including arabinofuranose (described in International Publication number WO 99/67378, which is herein incorporated by reference), xyloarabinofuranose (described in U.S. Pat. Nos. 6,316,612 and 6,489,465, which are herein incorporated by reference), α-threofuranose (Schöning, et al. (2000) Science, 290, 1347-51, which is herein incorporated by reference) and L-ribofuranose. Sugar mimetics can replace the sugar in the nucleotides. They include cyclohexene (Wang et al. (2000) J. Am. Chem. Soc. 122, 8595-8602; Vebeure et al. Nucl. Acids Res. (2001) 29, 4941-4947, which are herein incorporated by reference), a tricyclo group (Steffens, et al. J. Am. Chem. Soc. (1997) 119, 11548-11549, which is herein incorporated by reference), a cyclobutyl group, a hexitol group (Maurinsh, et al. (1997) J. Org. Chem., 62, 2861-71; J. Am. Chem. Soc. (1998) 120, 5381-94, which are herein incorporated by reference), an altritol group (Allart, et al., Tetrahedron (1999) 6527-46, which is herein incorporated by reference), a pyrrolidine group (Scharer, et al., J. Am. Chem. Soc., 117, 6623-24, which is herein incorporated by reference), carbocyclic groups obtained by replacing the oxygen of the furnaose ring with a methylene group (Froehler and Ricca, J. Am. Chem. Soc. 114, 8230-32, which is herein incorporated by reference) or with an S to obtain 4'-thiofuranose (Hancock, et al., Nucl. Acids Res. 21, 3485-91, which is herein incorporated by reference), and/or morpholino group (Heasman, (2002) Dev. Biol., 243, 209-214, which is herein incorporated by reference) in place of the pentofuranosyl sugar. Morpholino oligonucleotides are commercially available from Gene Tools, LLC (Corvallis Oreg., USA).

The DNAi oligonucleotides can also include "locked nucleic acids" or LNAs. The LNAs can be bicyclic, tricyclic or polycyclic. LNAs include a number of different monomers, one of which is depicted in Formula I.

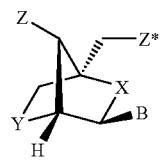

I wherein
B constitutes a nucleobase;
Z* is selected from an internucleoside linkage and a terminal group;
Z is selected from a bond to the internucleoside linkage of a preceding
nucleotide/nucleoside and a terminal group, provided that only one of Z and Z* can be a terminal group;
X and Y are independently selected from —O—, —S—, —N(H)—, —N(R)—, —CH$_2$— or —C(H)═, CH$_2$—O—, —CH$_2$—S—, —CH$_2$—N(H)—, —CH$_2$—N(R)—, —CH$_2$—CH$_2$— or —CH$_2$—C(H)═, —CH═CH—;
provided that X and Y are not both O.

In addition to the LNA [2'-Y,4'-C-methylene-β-D-ribofuranosyl]monomers depicted in formula XVIII (a [2,2,1] bicyclo nucleoside), an LNA or LNA* nucleotide can also include "locked nucleic acids" with other furanose or other 5 or 6-membered rings and/or with a different monomer formulation, including 2'-Y,3' linked and 3'-Y,4' linked, 1'-Y,3 linked, 1'-Y,4' linked, 3'-Y,5' linked, 2'-Y, 5' linked, 1'-Y,2' linked bicyclonucleosides and others. All the above mentioned LNAs can be obtained with different chiral centers, resulting, for example, in LNA [3'-Y-4'-C-methylene (or ethylene)-β (or α)-arabino-, xylo- or L-ribo-furanosyl]monomers. LNA oligonucleotides and LNA nucleotides are generally described in International Publication No. WO 99/14226 and subsequent applications; International Publication Nos. WO 00/56746, WO 00/56748, WO 00/66604, WO 01/25248, WO 02/28875, WO 02/094250, WO 03/006475; U.S. Pat. Nos. 6,043,060, 6,268,490, 6,770,748, 6,639,051, and U.S. Publication Nos. 2002/0125241, 2003/0105309, 2003/0125241, 2002/0147332, 2004/0244840 and 2005/0203042, all of which are incorporated herein by reference. LNA oligonucleotides and LNA analogue oligonucleotides are commercially available from, for example, Proligo LLC 6200 Lookout Road, Boulder, Colo. 80301 USA.

The nucleotide derivatives of the DNAi oligonucleotides can include nucleotides containing one of the following at the 2' sugar position: OH; F; O-, S-, or N-alkyl; O-, S-, or N-alkenyl; O—, S- or N-alkynyl; or O-alkyl-O-alkyl, wherein the alkyl, alkenyl and alkynyl may be substituted or unsubstituted $C_1$ to $C_{10}$ alkyl or $C_2$ to $C_{10}$ alkenyl and alkynyl, O[(CH$_2$)$_n$O]$_m$CH$_3$, O(CH$_2$)$_n$OCH$_3$, O(CH$_2$)$_n$NH$_2$, O(CH$_2$)$_n$CH$_3$, O(CH$_2$)$_n$ONH$_2$, and O(CH$_2$)$_n$ON[(CH$_2$)$_n$CH$_3$)]$_2$, where n and m are from 1 to about 10, $C_1$ to $C_{10}$ lower alkyl, substituted lower alkyl, alkaryl, aralkyl, O-alkaryl or O-aralkyl, SH, SCH$_3$, OCN, Cl, Br, CN, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, 2'-methoxyethoxy (2'-O—CH$_2$CH$_2$OCH$_3$, also known as 2'-O-(2-methoxyethyl) or 2'-MOE) (Martin et al., Helv. Chim. Acta 78:486 [1995]) i.e., an alkoxyalkoxy group, 2'-dimethylaminooxyethoxy (i.e., an O(CH$_2$)$_2$ON(CH$_3$)$_2$ group), also known as 2'-DMAOE, and 2'-dimethylaminoethoxyethoxy (also known in the art as 2'-O-dimethylaminoethoxyethyl or 2'-DMAEOE), i.e., 2'-O—CH$_2$—O—CH$_2$—N(CH$_2$)$_2$, 2'-methoxy (2'-O—CH$_3$), 2'-aminopropoxy(2'-OCH$_2$CH$_2$CH$_2$NH$_2$) and 2'-fluoro (2'-F). Similar modifications may also be made at other positions on the DNAi oligonucleotide, particularly the 3' position of the sugar on the 3' terminal nucleotide or in 2'-5' linked DNAi oligonucleotides and the 5' position of 5' terminal nucleotide.

In some embodiments, the DNAi oligonucleotides have non-natural internucleoside linkages. As defined in this specification, oligonucleotides having modified backbones include those that retain a phosphorus atom in the backbone and those that do not have a phosphorus atom in the backbone. For the purposes of this specification, modified oligonucleotides that do not have a phosphorus atom in their internucleoside backbone can also be considered to be oligonucleosides.

Some modified DNAi oligonucleotide backbones include, for example, phosphorothioates, chiral phosphorothioates, phosphorodithioates, phosphoroselenates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'. Various salts, mixed salts and free acid forms are also included.

Other modified DNAi oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH$_2$ component parts.

In yet other DNAi oligonucleotide mimetics, both the sugar and the internucleoside linkage (i.e., the backbone) of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, in particular an aminoethylglycine backbone. The nucleobases are retained and are bound directly or indirectly to aza nitrogen atoms of the amide portion of the backbone. Representative patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al., Science 254:1497 (1991).

In some embodiments, DMAi oligonucleotides of the invention are oligonucleotides with phosphorothioate backbones and oligonucleosides with heteroatom backbones, and in particular —CH$_2$—, —NH—O—CH$_2$—, —CH$_2$—N (CH$_3$)—O—CH$_2$— [known as a methylene (methylimino) or MMI backbone], —CH$_2$—O—N(CH$_3$)—CH$_2$—, —CH$_2$—N(CH$_3$)—N(CH$_3$)—CH$_2$—, and —O—N(CH$_3$)—CH$_2$—CH$_2$— [wherein the native phosphodiester backbone is represented as —O—P—O—CH$_2$—] of the above referenced U.S. Pat. No. 5,489,677, and the amide backbones of the above referenced U.S. Pat. No. 5,602,240. Oligonucleotides can also have a morpholino backbone structure of the above-referenced U.S. Pat. No. 5,034,506.

In some embodiments the DNAi oligonucleotides have a phosphorothioate backbone having the following general structure.

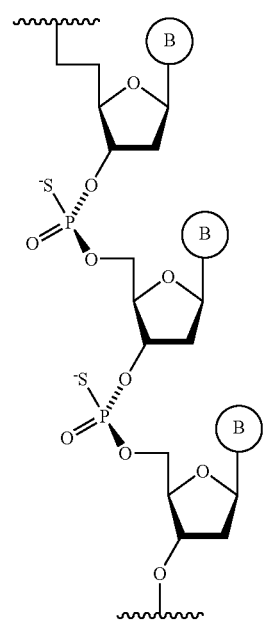

Another modification of the DNAi oligonucleotides of the present invention involves adding additional nucleotides to the 3' and/or 5' ends of the DNAi oligonucleotides. The 3' and 5' tails can comprise any nucleotide and can be as short as one nucleotide and as long as 20 nucleotides.

Yet another modification of the DNAi oligonucleotides of the present invention involves chemically linking to the oligonucleotide one or more moieties or conjugates that enhance the activity, cellular distribution or cellular uptake of the oligonucleotide. Such moieties include but are not limited to lipid moieties such as a cholesterol moiety, cholic acid, a thioether, (e.g., hexyl-5-tritylthiol), a thiocholesterol, an aliphatic chain, (e.g., dodecandiol or undecyl residues), a phospholipid, (e.g., di-hexadecyl-rac-glycerol or triethylammonium 1,2-di-O-hexadecyl-rac-glycero-3-H-phosphonate), a polyamine or a polyethylene glycol chain or adamantane acetic acid, a palmityl moiety, or an octadecylamine or hexylamino-carbonyl-oxycholesterol moiety.

One skilled in the relevant art knows well how to generate oligonucleotides containing the above-described modifications. The present invention is not limited to the DNAi oligonucleotides described above. Any suitable modification or substitution may be utilized, provided that the DNAi oligonucleotide is a single stranded nucleic acid oligonucleotide or derivative thereof, whose sequence is complementary, in part, to a portion of the longest non-transcribed region of a gene in which the oligonucleotide affects indirectly or directly the expression, regulation or production of the same or different gene, wherein the longest non-transcribed region includes any portion of the gene that is not transcribed when the transcriptional start site is the site closest to the translation start site. DNAi oligonucleotides do not include RNAi and antisense oligonucleotides that base pair only with mRNAs or pre-mRNAs and interfere with RNA processing and/or message translation.

It is not necessary for all positions in a given compound to be uniformly modified, and in fact more than one of the aforementioned modifications may be incorporated in a single compound or even at a single nucleoside within a DNAi oligonucleotide. The present invention also includes pharmaceutical compositions and formulations that include the DNAi oligonucleotide compounds of the present invention as described below.

5. Preparation and Formulation of DNAi Oligonucleotides

Any of the known methods of oligonucleotide synthesis can be used to prepare the modified DNAi oligomers of the present invention. In some embodiments utilizing methylated DNAi oligonucleotides the nucleotide, dC is replaced by 5-methyl-dC where appropriate, as taught by the present invention. The modified or unmodified DNAi oligonucleotides of the present invention are most conveniently prepared by using any of the commercially available automated nucleic acid synthesizers. They can also be obtained from commercial sources that synthesize custom oligonucleotides pursuant to customer specifications.

In additional embodiments, chemotherapeutic agents, including docetaxel and others can be combined with DNAi oligomers before or while sequestering in liposomes.

C. Amphoteric Liposome Formulations

1. Description

Advantageously, the amphoteric liposome formulations of the mixture of the present invention (1) exhibit low toxicity; (2) can sequester high concentrations of DNAi oligomers e.g., the efficiency of sequestering the DNAi oligonucleotides associated with the amphoteric liposomes is at least about 35%; (3) are stable in the bloodstream, such as when administered systemically, such that the oligonucleotide and/or other agents are stably sequestered in the liposomes until eventual uptake in the target tissue or cells; (4) can be optimized for delivery to animals, such as by adjusting the concentration of sequestered DNAi oligonucleotide to between about 1 to 4 mg/ml (such as about 2 mg/ml) for a lipid concentration of about 10 to 100 mM or less which provides dosing at 10 mg/kg in 200 μl of injection volume; and (5) can be produced with an average amphoteric liposome size that is smaller than 200 ηm, such as about 100 ηm, which maximizes tumor penetration.

As described above, the amphoteric liposomes include one or more DNAi oligonucleotides, one or more amphoteric lipids or a mixture of anionic and cationic lipid components with amphoteric properties and one or more neutral lipids.

In general, cationic lipids or positive charges on the amphoteric lipids act to bind DNAi oligonucleotides. Anionic lipids, such as CHEMS, or anionic charges on amphoteric lipids and neutral lipids, such as phosphatidylethanolamines allow for the fusogenic properties of the amphoteric liposomes.

In some embodiments of the present invention, the amphoteric liposomes can be formed from a lipid phase comprising an amphoteric lipid. The lipid phase can comprise 5 to 30 mole % or 10 to 25 mole % of the amphoteric lipid. Alternatively, the amphoteric liposomes can be formed from a lipid phase comprising a mixture of lipid components with amphoteric properties. The total amount of charged lipids may vary from 5 to 95 mole %, from 20 to 80 mole % or from 30 to 70 mole % of the lipid mixture.

The ratio of the percent of cationic lipids to anionic lipids can be between about 3 and 0.5 or between about 2 to 0.5. In some embodiments, the ratio of cationic lipids to anionic lipids is about 2. In other embodiments, the ratio of cationic lipids to anionic lipids is about 1. In other embodiments, the ratio of cationic lipids to anionic lipids is about 0.5.

Specific pairs of cationic and anionic lipids include, without limitation, MoChol and CHEMS, DOTAP and CHEMS, MoChol and Cet-P, and MoChol and DMGSucc. Examples of charged lipid pairs further include, without limitation, between about 10 to 60 mole % of MoChol and between about 10 to 30 mole % of CHEMS; between about 5 to 30 mole % of DOTAP and between about 10 to 30 mole % of CHEMS; between about 10 to 40 mole % MoChol and between about 5 to 30 mole % Cet-P; and between about 20 to 60 mole % MoChol and between about 20 to 60 mole % DMGSucc.

The amphoteric liposomes also contain neutral lipids, which can be either sterols or phospholipids, and mixtures thereof. The amphoteric liposomes include neutral lipids in an amount between about 5 to 95 mole % of the lipid mixture, between about 20 to 80 mole %, or between 30 and 70 mole %.

A number of neutral lipid combinations are useful in forming the amphoteric liposomes, such as POPC and DOPE; and POPC and cholesterol. In contrast, a combination of the neutral lipids DOPE and cholesterol is not preferred. In some embodiments, the mixture of neutral lipids includes 5 to 40 mole % POPC and 20 to 50 mole % DOPE; or 10 to 50 mole % of POPC and 30 to 50 mole % of cholesterol. The ratio of the percentage of charged lipids to neutral lipids can be between about 3 and 0.2. In some embodiments, the ratio of the percentage of charged lipids to neutral lipids is about 2. In other embodiments, the ratio of the percentage of charged lipids to neutral lipids is about 0.5.

Examples of specific combinations of charged and neutral lipids for sequestering an DNAi oligomer, such as PNT-100 (SEQ ID NO:1251), include POPC, DOPE, MoChol and CHEMS; POPC, DOPE, DMGSucc and MoChol; POPC, DOTAP, CHEMS and cholesterol; and POPC, MoChol, Cet-P and cholesterol. In some embodiments, the amphoteric liposome for sequestering a DNAi oligomer, such as SEQ ID NO:1251, includes 3-20 mole % of POPC, 10 to 60 mole % of DOPE, 10 to 60 mole % of MoChol and 10 to 60 mole % of CHEMS. The amphoteric liposome may include POPC/DOPE/oChol/CHEMS in molar ratios of about 6/24/47/23 and about 15/45/20/20. In another embodiment, the amphoteric liposomes include 3-20 mole % of POPC, 10 to 40 mole % of DOPE, 15 to 60 mole % of MoChol and 15 to 60 mole % of DMGSucc. The amphoteric liposome can include POPC/DOPE/DMGSucc/MoChol in molar ratios of about 6/24/23/47 and about 6/24/47/23. In still another embodiment, the amphoteric liposome includes 10 to 50 mole % of POPC, 20 to 60 mole % of Chol, 10 to 40 mole % of CHEMS and 5 to 20 mole % of DOTAP. The amphoteric liposome can include POPC/Chol/CHEMS/DOTAP in a molar ratio of about 30/40/20/10. In still another embodiment, the amphoteric liposome includes 10 to 40 mole % of POPC, 20 to 50 mole % of Chol, 5 to 30 mole % of Cet-P and 10 to 40 mole % of MoChol. The amphoteric liposome can include POPC/Chol/Cet-P/MoChol in a molar ratio of about 35/35/10/20.

In general, any Amphoter I, II, or III lipid pair of cationic and anionic lipids together with neutral lipids can be used to form liposomes provided that the resulting liposome is amphoteric, exhibits serum stability, has low toxicity, sequesters an ample quantity of the DNAi oligonucleotides, e.g., at an efficiency of about 35%, (about 5%, 10%, 15%, 20%, 25%, 30%, 35% or higher) and provides for an adjustment of the DNAi oligonucleotide concentration to at least 2 mg/ml for a lipid concentration of 100 mM or less.

2. Preparation of the Amphoteric Liposomes

DNAi-amphoteric liposomes of the invention can be prepared by standard methods for preparing and sizing liposomes known to those skilled in the art. These include hydration of lipid films and powders, solvent injection and reverse-phase evaporation. Often multilamellar vesicles will form spontaneously when amphiphilic lipids are hydrated, whereas the formation of small unilamellar vesicles usually requires a process involving substantial energy input, such as ultrasonication, high pressure homogenization, injection of lipid solutions in ethanol into a water phase containing the DNAi oligonucleotides to be sequestered and/or extrusion through filters or membranes of defined pore size. Methods for preparing and characterizing liposomes have been described, for example, by S. Vemuri et al. (Preparation and characterization of liposomes as therapeutic delivery systems: a review. Pharm Acta Helv. 1995, 70(2):95-111.).

A solution of the DNAi oligonucleotide may be contacted with an excipient at a neutral pH, thereby resulting in a passive loading procedure of a certain percentage of the solution. The use of high concentrations of the excipient, ranging from about 50 mM to about 150 mM, is one method to achieve substantial encapsulation of the active agent. Excipients include substances that can initiate or facilitate loading of DNAi oligonucleotides. Examples of excipients include, without limitation, acid, sodium or ammonium forms of monovalent aniond such as chloride, acetate, lactobionate and formate; divalent anions such as aspartate, succinate and sulfate; and trivalent ions such as citrate and phosphate.

Amphoteric liposomes used with the present invention offer the distinct advantage of binding oligonucleotides at or below their isoelectric point, thereby concentrating the active agent at the liposome surface. The advanced loading procedure is described in more detail in PCT International Publication Number WO02/066012.

To form unilammellar liposomes, a shearing force is applied to the aqueous dispersion of the DNAi-oligonucleotide lipid mixture. The shearing force can be applied by sonication, using a microfluidizing apparatus such as a homogenizer or French press, injection, freezing and thawing, dialyzing away a detergent solution from lipids, ultrafiltration, extrusion through filters, or other known methods used to prepare liposomes. The size of the liposomes can be controlled using a variety of known techniques, including the duration of shearing force.

Unentrapped DNAi oligomers can be removed from the amphoteric liposome dispersion by buffer exchange using dialysis, size exclusion chromatography (e.g., Sephadex G-50 resin), ultrafiltration (100,000-300,000 molecular weight cutoff), or centrifugation.

In one embodiment, DNAi oligonucleotide loaded amphoteric liposomes may be manufactured by a machine extrusion. Once the lipids are mixed with the oligonucleotides, they may be extruded using machine extrusion, where the machine is described in U.S. Pat. No. 6,843,942 and US Patent Application No. 2004/0032037. The liposomes are loaded and filtered so that the diameter of the liposome is between 50 ηm and 200 ηm, the encapsulation efficiency of the oligonucleotide is at least about 35% and the resulting liposomes have a DNAi oligonucleotide concentration of at least 2 mg/ml at a lipid concentration of 10 to 100 mM or less.

VII. Treating Animals or Cells with Amphoteric Liposomes Sequestering DNAi Oligomers The compositions of the invention are useful for treating animals, including humans, or cells to treat cancer, such as by inhibiting or reducing tumor growth. The animal can be a non-human animal, including mice, horses, cats, dogs, or other animals or it can be a human. In one embodiment, the mixture is introduced to the animal at a dosage of between 1 mg to 100 mg/kg of body weight. In another embodiment, the amphoteric liposomes can be introduced to the animal one or more times per day or continuously.

The mixture can be administered to the animal via different routes. Administration can be topical (including ophthalmic and to mucous membranes including vaginal and rectal delivery), pulmonary (e.g., by inhalation or insufflation of powders or aerosols, including by nebulizer; intratracheal, intranasal, epidermal and transdermal), oral or parenteral. Parenteral administration includes intravenous, intraarterial, subcutaneous, intraperitoneal or intramuscular injection or infusion; or intracranial, e.g., intrathecal or intraventricular, administration. Administration can also be via a medical device.

The liposomes can be administered to cultured cells derived from various cancers, including pancreatic cancer, colon cancer, breast cancer, bladder cancer, lung cancer, leukemia, prostate cancer, lymphoma, ovarian cancer or melanoma.

The liposomes can be used to target DNAi oligonucleotides to selected tissues using several techniques. The procedures involve manipulating the size of the liposomes, their net surface charge as well as the route of administration. More specific manipulations include labeling the liposomes with receptor ligands, including membrane and nuclear receptor ligands or antibodies for specific tissues or cells. Antibodies or ligands can be bound to the surface of the liposomes.

The invention will be further described in the following examples, which do not limit the scope of the invention described in the claims.

EXAMPLES

Example 1

Materials

The synthesis of MoChol and His Chol were described in US Patent Application No. 2004/0131666 (WO 02/066490). The other lipids are available from commercial sources. For example, DOTAP and Cholesterol are available from Merck, DMG-Succ is available from Chiroblock GmbH, CHEMS can be obtained from Sigma Chemical Company, DPPG, DOPE and POPC are available from Genzyme or Lipoid GMBH and Egg phosphatidylcholine is available from Lipoid GMBH.

Example 2

Production of Amphoteric Liposomes Charged with DNAi Oligonucleotides

The lipid composition of the liposomes as well as the methods of preparing them are chosen so that the encapsulation efficiency is about 35% or higher and the liposome size is smaller than 200 ηm, and optimally near 100-120 ηm to maximize tumor penetration. For administering to animals, the DNAi oligonucleotide concentration is preferably at least 2 mg/ml at a lipid concentration of 100 mM or less. This allows dosing at 10 mg/kg in 200 μl of injection volume.

Liposomes are produced by a modified lipid film/hydration/extrusion method. Lipids are dissolved in chloroform or chloroform/methanol and dried completely in a rotary evaporator. The lipid films are next hydrated with various amounts of the DNAi oligonucleotides SEQ ID NO:1251 (PNT100) or the complement of PNT-100 (PNT-100R) hydrated in buffer.

A. Advanced Loading Procedure

2400 μmole of lipid is hydrated with 10 mM NaOAc, 150 mM NaCl (pH adjusted using citrate) containing 48.8 to 95.2 mg of DNAi oligonucleotides for 30 min. at 40° C. After three freeze-thaw steps, the resulting multilamellar vesicles is passed several times through a polycarbonate membrane (100 ηm pore size) using high pressure pumps. Immediately after the extrusion step, the pH of the liposome suspension is shifted to pH 7.5. The resulting suspension is sedimented at 25 s using T865 (Sorvall Ultra Pro80) or TLA 100.4 rotors (Beckman Optima-MAX) to remove unsequestered DNAi oligonucleotide and to exchange the buffer with phosphate buffered saline (PBS).

B. Passive Loading Procedure

The lipid film is hydrated with PBS containing 405 mg of DNAi oligonucleotides for 1 hr at 40° C. at a final lipid concentration of 100 mM. After three freeze-thaw steps, the resulting vesicles are extruded through a polycarbonate membrane stack containing different pore sizes between 100 and 800 nm. The resulting suspension is sedimented three times at 25 s. (PBS is Phosphate Buffered Saline, which has the formula: 10.1 mM $Na_2PO_4$, 1.76 mM $KH_2PO_4$, 137 mM NaCl, 2.68 mM KCl, pH 7.5.)

C. Machine Extrusion

The vesicles are prepared by either the passive or advanced loading procedure and extruded using a device for producing lipid vesicle.

Particle properties were measured using a Zetasizer 3000 HAS (Malvern). Liposomes were diluted in appropriate buffer to a final lipid concentration of 0.2-0.6 mM. Size values are recorded as Z average and size distribution was calculated in the Multimodal mode. For Zeta potential measurement, liposomes were also diluted to 0.2-0.6 mM concentration.

TABLE 2

Liposome Formulations

| Formulation | Composition | Molar Ratios |
| --- | --- | --- |
| A | POPC/DOPE/MoChol/CHEMS | 15/45/20/20 |
| B | POPC/DOTAP/CHEMS/Chol | 30/10/20/40 |
| C | POPC/MoChol/Cet-P/Chol | 35/20/10/35 |
| D | POPC/DOPE/MoChol/CHEMS | 6/24/47/23 |
| E | POPC/DOPE/MoChol/DMG-Succ | 6/24/47/23 |
| F | POPC/DOPE/MoChol/DMG-Succ | 6/24/23/47 |

For all formulations in Table 2, active loading using either manual or machine extrusion in general gave better results. The encapsulation efficiencies ranged from 37-77%, liposome size ranged from 124-201 ηm and the DNAi oligonucleotide concentration at a lipid concentration of 100 mM ranged from 1.1 to 3.5 mg/ml. Machine extrusion gave similar results as manual extrusion with the possible exception that machine extrusion resulted in more uniform liposome size, ranging from 135-179 ηm. Machine extrusion is preferred for larger volumes.

The passive loading procedure resulted in lower encapsulation efficiencies, ranging from 11-21%. However, liposome size ranged from 122-182 nm and the oligonucleotide concentration at a lipid concentration of 100 mM ranged from 2.0-3.7 mg/ml. All formulations that were passively loaded were manually extruded because attempts at machine extrusion created a high back pressure.

The advanced loading procedure could not be used for all formulations because of the low loading capacity of formulations that contain less than 20% cationic lipid. Consequently, formulation B with DOTAP at 10%, could not be loaded efficiently by the advanced loading procedure, and the passive loading procedure was used.

A ratio of cationic lipid charge to anionic nucleotide charge at low pH(N/P) of 3.3 was found to be the best compromise to produce small particles, high encapsulation efficiency and DNAi oligonucleotide concentration to lipid concentration of at least 2.0 mg/ml of DNAi oligonucleotide at 10 to 100 mM lipid concentration.

D. Preparation of PNT 2254 and PNT 2253

Liposomes are produced with a modified ethanol injection method. Briefly, 3 volumes of ethanol, containing the lipid mixture D (POPC/DOPE/MoChol/Chems 6:24:47:23) (133 mM, heated to 55° C.) and 8 volumes of 20 mM NaAc/300 mM Sucrose/pH 4, containing 2.71 mg/ml PNT100 (SEQ ID NO: 1251) or PNT100-R (SEQ ID NO: 1288) in case of PNT2254 or PNT2254R production, or containing 1.36 mg/ml PNT100 in case of PNT2253 production, were continuously mixed using an injection device as disclosed in U.S. Pat. No. 6,843,942 and US patent application No. 2004/0032037. The acidic mixture was shifted to pH 7.5 by an additional continuous mixing step with 32 volumes of 100 mM NaCl/136 mM Phosphate/pH 9. The resulting liposomal suspension was concentrated 10 fold and dialyzed against PBS, pH 7.4 to wash out non encapsulated PNT100 or PNT100-R and excess ethanol.

Example 3

Serum Resistance of and Leakage of DNAi Oligonucleotides from Amphoteric Liposomes The lipid ratios can be optimized for both stability of the liposomes in serum and minimal leakage of the DNAi oligonucleotides. The above formulations are stable in serum and can exhibit minimal leakage of oligonucleotide.

Example 4

Response of WSU-DLCL2 Tumors to PNT-100

Three formulations which met the specifications of at least 2 mg/ml of encapsulated PNT-100 (SEQ ID NO:1251), greater than 40% encapsulation efficiency and less than 200 ηm particle size (formulations B, D, and F, see example 2) were tested in a human lymphoma model. Lymphoma cells (WSU-DLCL$_2$—Wayne State University Diffuse Large Cell Lymphoma) were obtained from Dr. Ramzi Mohammad, Karmanos Cancer Institute, Wayne State University. Xenografts were transplanted subcutaneously into C17/SCID mice. Seven days after transplantation, mice were injected intravenously with 10 mg/kg of the PNT-100 (SEQ ID NO:1251) formulations and 10 mg/kg of PNT-100R (SEQ ID NO:1288) formulations. The injections were performed daily for 8 days in six mice. The size of the tumors were measured up to 30 days after implantation. All animals survived with no gross toxic pathology.

Results in FIG. 1 show that PNT-100 slows tumor growth. 340.9 and 340.8 are formulations with PNT-100 and PNT-100R, respectively. Formulation D with PNT-100 slowed tumor growth better and was less toxic than formulations B and F. (Data not shown.)

Figure 2:
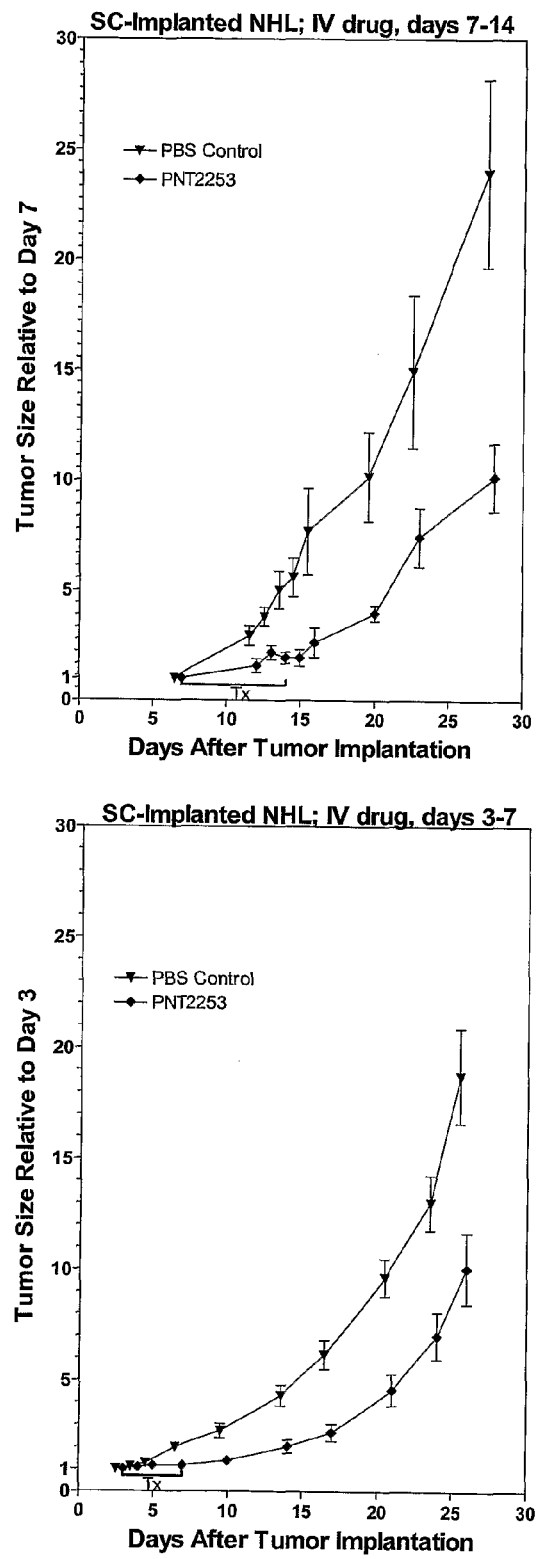
FIG. 2 shows the effect of different lots of SEQ ID NO:1251 sequestered in amphoteric liposomes on the size of tumors from non-Hodgkin's Lymphoma WSU-DLCL2 xenografts in SCID mice.

Experiments done with other lots of PNT-100-liposome formulation D gave similar results, as shown in FIG. 2. Mice were administered 10 mg/kg PNT2253 daily for eight days, an i.v. bolus injection and tumor volume response was caliper measured (left panel). Data show 57% tumor growth inhibition at day 28 post xenograft transplantation or 14 days post drug treatment (n=6; p=0.004). Mice were administered 10 mg/kg PNT2253 daily for five days an i.v. bolus injection and tumor response was caliper measured. Data shows 46% tumor growth inhibition at day 26 post xenograft transplantation or 19 days post drug treatment (n=8; p=0.007). Studies were concluded when control animal xenografts reached >2000 mm$^3$.

Figure 3:
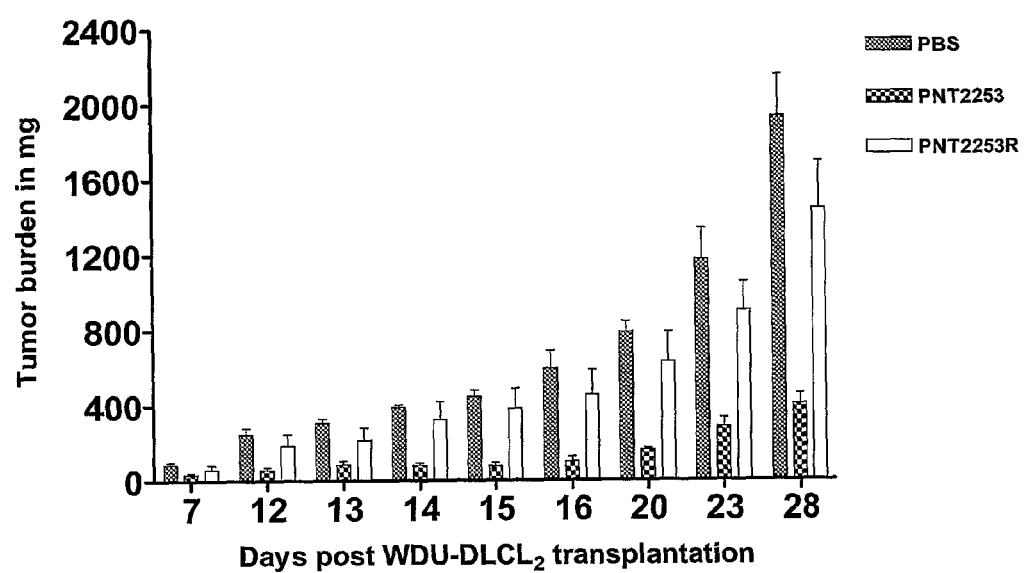
FIG. 3 shows the tumor burden in mice carrying non-Hodgkin's Lymphoma WSU-DLCL2 xenografts treated with SEQ ID NO:1251 sequestered in amphoteric liposomes.

The tumor burden was calculated from the size measurements of the tumors. FIG. 3 shows that the tumor burden in mice treated with PNT2253, which is PNT-100 in formulation D, was dramatically less than the tumor burden in mice treated with PNT2253R (PNT-100R in formulation D) or PBS.

A dose response experiment was performed in WSU-DLCL2 xenograft bearing mice with PNT-100 in formulation D, with a PNT-100 concentration of 4 mg/ml (PNT2254) and 2 mg/ml (PNT2253). C.B.-17 ACID mice between 6-8 weeks old were supplied by Taconic (Hudson, N.Y.). When the tumors reached approximately 100 mm3 volume, treatment with PNT2253 or PNT2254 was initiated. The mice received 0, 0.3, 3, 10, or 20 mg/kg of PNT2254 daily for five days, 30 mg/kg of PNT2254 daily for 2 days, 60 mg/kg of PNT2254 once, 0.3, 3, or 10 mg/kg of PNT2253 daily for 5 days, 20 mg/kg of PNT2253 daily for 2 days, or 30 mg/kg of PNT2253 once via an iv bolus injection. (n=7 (PNT2254) or 8 (PNT2255). The animals were checked at least three times weekly for tumor growth by caliper measurements, and the animals were weighed at least three times weekly. Tumor volumes of all treatment groups were analyzed using GraphPad™ statistical software.

Figure 4:
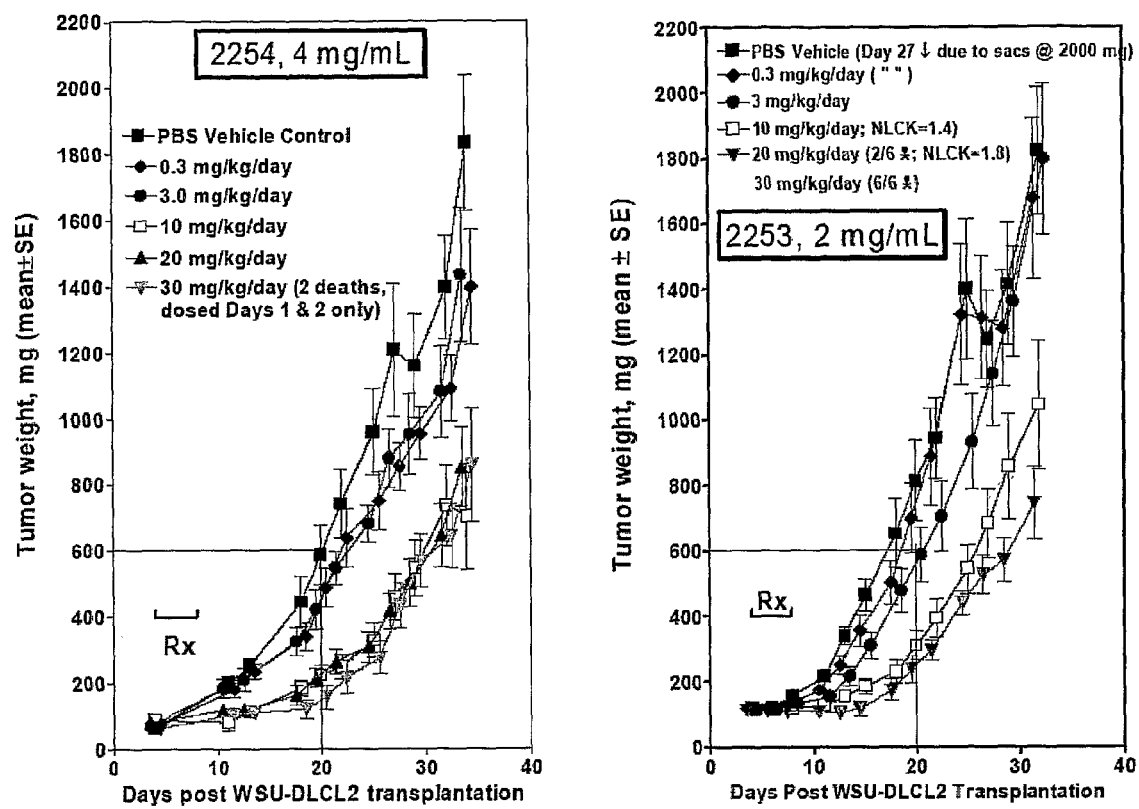
FIG. 4 shows a dose response evaluation of two formulations of SEQ ID NO:1251 sequestered in amphoteric liposomes on WSU-DLCL2 xenograft bearing mice.
Figure 5:
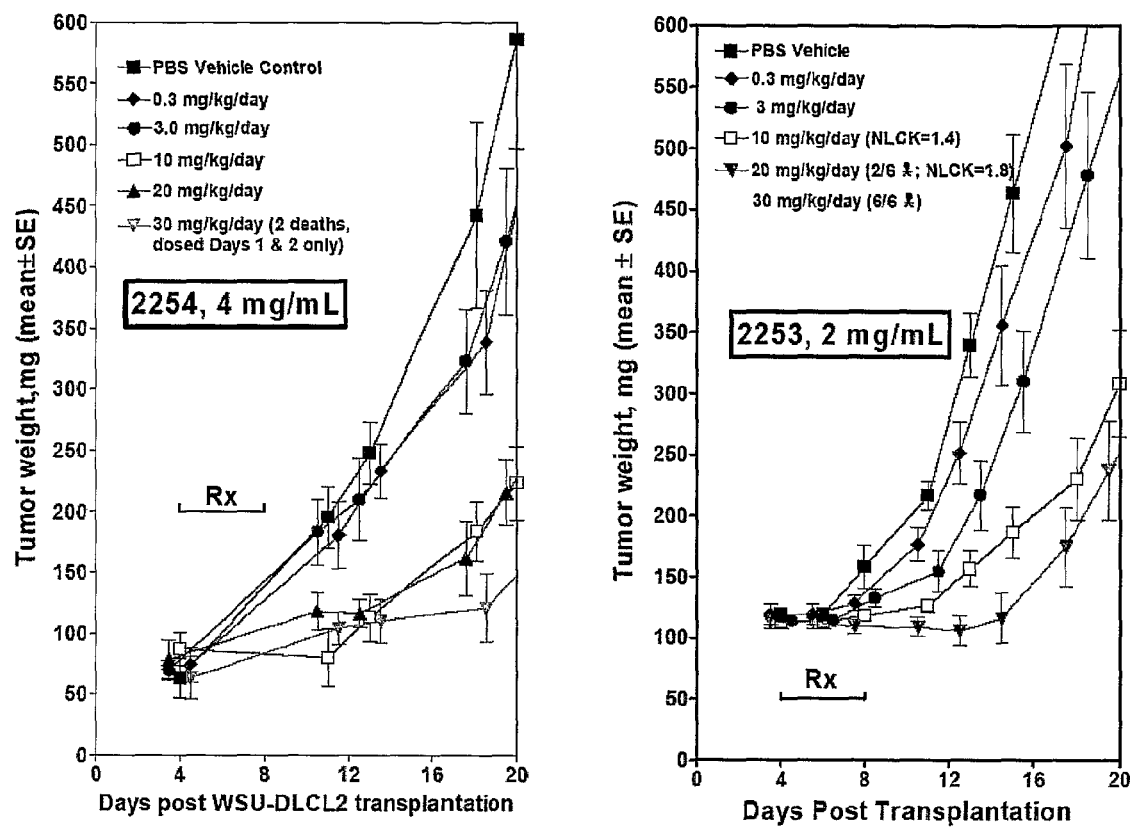
FIG. 5 shows an enlarged view of a dose response evaluation of two formulations of SEQ ID NO:1251 sequestered in amphoteric liposomes on WSU-DLCL2 xenograft bearing mice.
Figure 6:
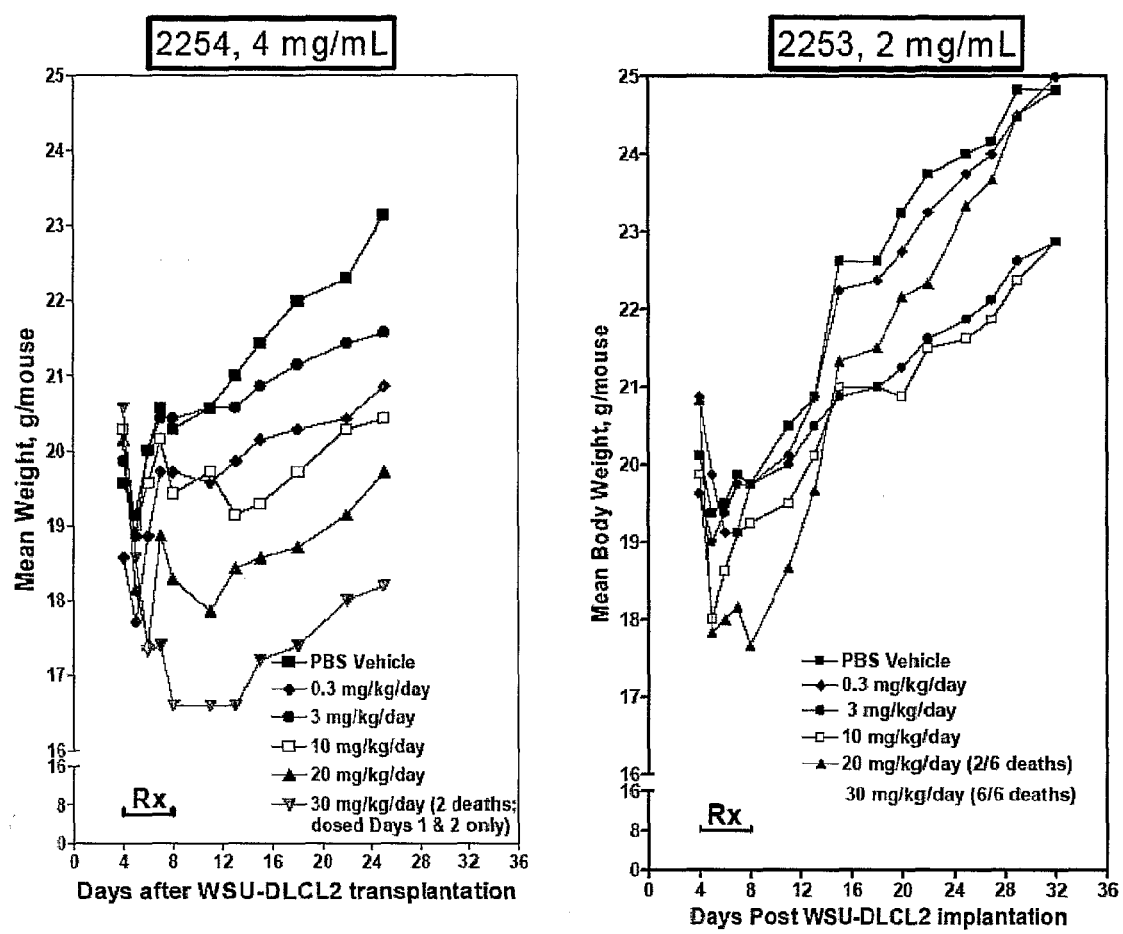
FIG. 6 shows a dose response animal body weight evaluation in WSU-DLCL2 xenograft bearing mice treated with two formulations of SEQ ID NO:1251 sequestered in amphoteric liposomes.

A maximum tolerated dose of 20 mg/kg/day of PNT2254 and 10 mg/kg/day of PNT2253 was established. (FIGS. 4 and 5.) Toxicity was achieved at 30 mg/kg/day for PNT2254 and at 20 mg/kg/day for PNT2253, and dosing was stopped after two days due to animal efficacy. A steep dose response was seen with strong anti-tumor efficacy for an extended time period after one dosing cycle. The effect of the two formulations at various dosages on body weight of the mice was determined and is shown in FIG. 6. For both formulations, a dose of 10 mg/kg/day was efficacious while causing minimal weight loss.

A mathematical measure of each dose was calculated that determined the drug response in delaying tumor growth rate to 750 mg size in PNT2254 and PNT2253 drugged vs. control non-drugged tumors (Tables 3 and 4).

TABLE 3

Antitumor Activity of PNT2254 in WSU-DLCL$_2$-Bearing SCID Mice

| Agent | No. of Animals | T/C (%) | T-C | Log$_{10}$ kill gross |
|---|---|---|---|---|
| PBS control daily for 5 days | 7 | 100 | 0.0 | 0.0 |
| 0.3 mg/kg PNT2254 daily for 5 days | 7 | 100 | 0.0 | 0.0 |
| 3 mg/kg PNT2254 daily for 5 days | 7 | 75 | 3 | 0.45 |
| 10 mg/kg PNT2254 daily for 5 days | 7 | 34 | 10 | 1.5 |
| 20 mg/kg PNT2254 daily for 5 days | 7 | 32 | 10 | 1.5 |
| 30 mg/kg PNT2254 daily for 2 days | 5 (5/7 mice survived) | 27 | 11 | 1.65 |

TABLE 4

Antitumor Activity of PNT2253 in WSU-DLCL$_2$-Bearing SCID Mice

| Agent | No. of Animals | T/C (%) | T-C | Log$_{10}$ kill gross |
|---|---|---|---|---|
| PBS control daily for 5 days | 8 | 100 | 0.0 | 0.0 |
| 0.3 mg/kg PNT2253 daily for 5 days | 8 | 92 | 0.0 | 0.0 |
| 3 mg/kg PNT2253 daily for 5 days | 8 | 90 | 2 | 0.3 |
| 10 mg/kg PNT2253 daily for 5 days | 8 | 38 | 9 | 1.4 |
| 20 mg/kg PNT2253 daily for 2 days | 6 (6/8 mice survived | 28 | 12 | 1.8 |
| 30 mg/kg PNT2253 daily for 1 day | 8 (8/8 dead) | — | — | — |

T and C are the median times in days for the treatment group (T) and the control group (C) tumors to reach a predetermined weight (750 mg). T−C is a measure of tumor growth delay and is the difference in the median days to 750 mg between the treated (T) and the control (C) group. $Log_{10}$ kill Gross=T−C value in days/3.32 X $T_d$. $T_d$ is the mean tumor doubling time (days) estimated from a log-linear growth plot of the control tumors growing in exponential phase. The higher the $Log_{10}$ kill Gross value, the more efficacious the drug, and a value over 2.8 is considered highly efficacious (Corbett, T. H. et al., "Transplantable Syngeneic Rodent Tumors". *Tumor Models in Cancer Research*. Ed. Teicher B. A. Totowa, N.J.: Humana Press Inc., 2002. 41-71). Volume and weight were calculated according to the formula described by Cammisuli, S., et al., Int. J. Cancer, 65, 351-9, 1996.

PNT2253 treatment resulted in increased toxicity compared to PNT2254. The most efficacious dose was 10 mg/kg/day for both PNT2253 and PNT2254, and the maximum tolerated dose is 20 mg/kg/day for PNT2254 and 10 mg/kg/day of PNT2253.

Example 5

Response of PC-3 Tumors to PNT-100

Figure 7:
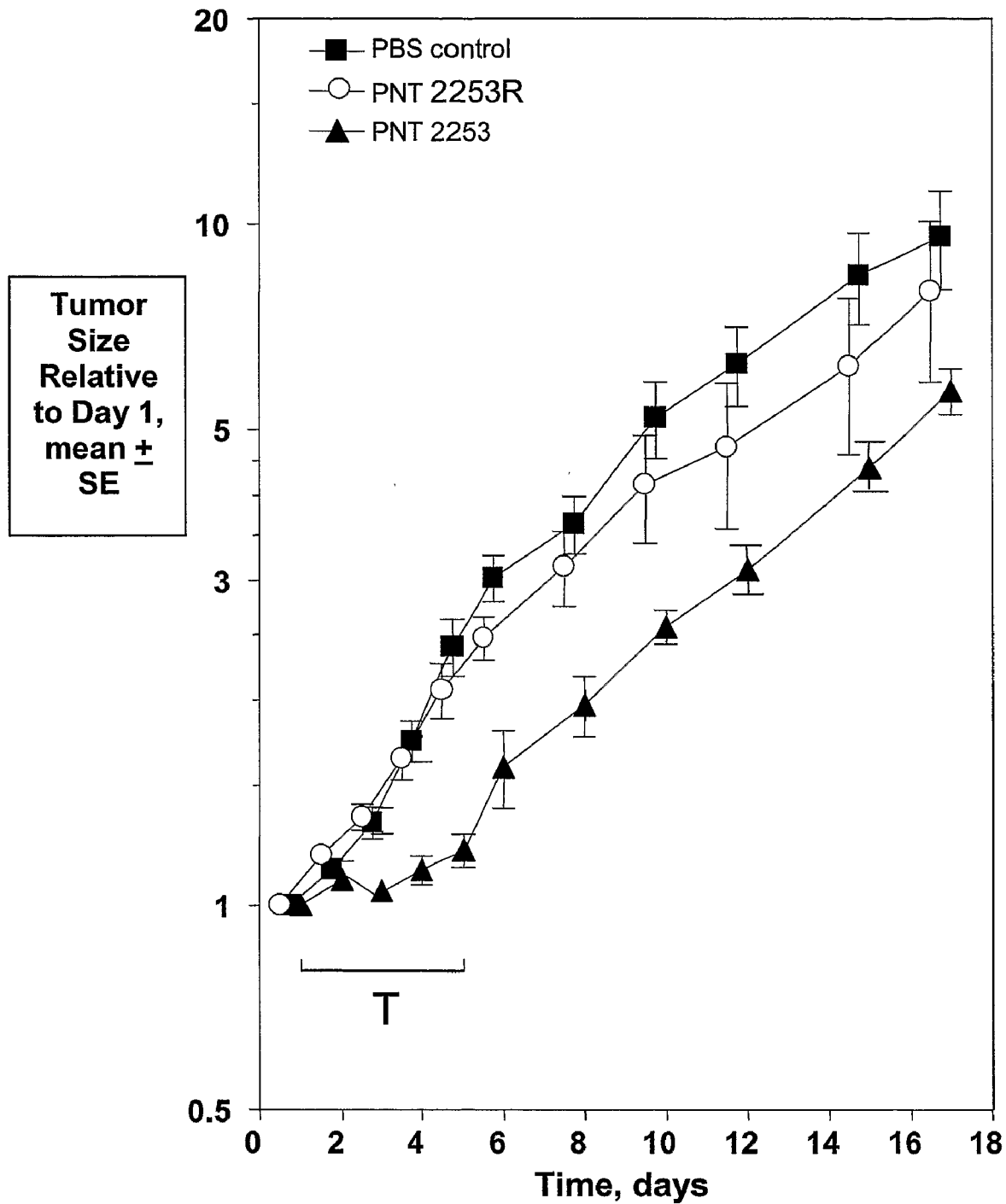
FIG. 7 shows the effect of SEQ ID NO:1251 sequestered in amphoteric liposomes on the size of tumors from PC-3 xenografts in nude mice.
Figure 8:
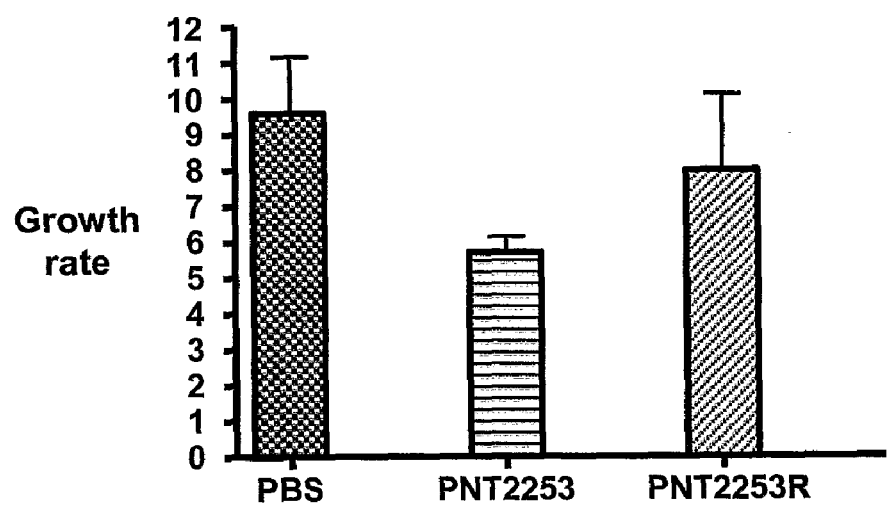
FIG. 8 shows the effect of SEQ ID NO:1251 sequestered in amphoteric liposomes on the growth rate of tumors from PC-3 xenografts in nude mice.

The different formulations were tested in a PC-3 human prostate carcinoma model. Xenografts were generated by sub-cutaneous injection of 2×10$^6$ PC-3 cells (ATCC CRL 1435) into nude mice. Mice bearing 50-200 mm$^3$ xenografts were injected intravenously with 10 mg/kg of PNT-100 (SEQ ID NO:1251) or PNT-100R (SEQ ID NO:1288) in one of the formulations B, D or F on days 1, 2, and 5 and with 7.5 mg/kg on days 3 and 4. Results show a decrease in tumor growth with PNT-100, but not with PNT-100R (FIGS. 7 and 8). N=5.

Example 6

Toxicity in Monkeys

Toxicity of PNT-100 in formula D was explored in Cynomolgus monkeys. Two primates were treated via two hour i.v. infusion with PBS control, 5 mg/kg PNT2254, 25 mg/kg PNT2254, and one primate was treated with 67 mg/kg PNT2254. There was a one week "washout" period between each dosing. Liver enzymes toxicology analysis, complement activation, and gross behavior and physiology measurements were collected before and after each treatment. The purpose of the study was to establish a maximum tolerated dose threshold, and to ensure that there was not a CARPA toxic response to the PNT2254 lipids. CARPA is a toxic response that is historically known to result from a non-classical complement pathway activation toxic response that can cause extreme hypertension and death. The primates tolerated and survived all doses and only a classical complement activation and not non-classical (innate) complement activation was detected. The liver enzyme toxicology analysis demonstrated modest increases in liver enzyme response to PNT2254.

OTHER EMBODIMENTS

It is to be understood that while the invention has been described in conjunction with the detailed description thereof, the foregoing description is intended to illustrate and not limit the scope of the invention, which is defined by the scope of the appended claims. Other aspects, advantages and modifications are within the scope of the following claims.

All references cited herein are incorporated herein by reference in their entirety.

SEQUENCE LISTING (1479 sequences)

SEQ ID NO: 1 - DNA, 541 bp, Homo sapiens
cccgggggtcctggaagccacaaggtaaacacaacacatccccctccttgactatcaattttactagaggatgtggtgggaaaaccattatttgatattaaaacaaataggcttgggatggagtaggatgcaagctccccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccaggcgtcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccaggggagccccccggg

SEQ ID NO: 2 - DNA, 24 bp, Artificial
  synthetic oligonucleotide
  modified_base (4)..(4): c or methylated C nucleotide
  modified_base (6)..(6): c or methylated C nucleotide
  modified_base (17)..(17): c or methylated C nucleotide
aagcgcgctcccagctcgccccct

SEQ ID NO: 3 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggg

SEQ ID NO: 4 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccct

SEQ ID NO: 5 - DNA, 33 bp, Artificial
  synthetic oligonucleotide
  modified_base (1)..(1): c or methylated C nucleotide
  modified_base (3)..(3): c or methylated C nucleotide
  modified_base (17)..(17): c or methylated C nucleotide
  modified_base (29)..(29): c or methylated C nucleotide
  modified_base (32)..(32): c or methylated C nucleotide
cgcgcaggcctgggtgcgtccctcctagcgccg

SEQ ID NO: 6 - DNA, 25 bp, Artificial
  synthetic oligonucleotide
  modified_base (4)..(4): c or methylated C nucleotide
  modified_base (22)..(22): c or methylated C nucleotide
agccgttctcacacttttcctcgga

SEQ ID NO: 7 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 8 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccct

SEQ ID NO: 9 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgg

SEQ ID NO: 10 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgg

SEQ ID NO: 11 - DNA, 21 bp, Artificial
  synthetic oligonucleotide
gtggcttccaggacccccggg

SEQ ID NO: 12 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 13 - DNA, 33 bp, Artificial; identical to SEQ ID NO: 8
  synthetic oligonucleotide
  modified_base (13)..(13): c or methylated C nucleotide
  modified_base (15)..(15): c or methylated C nucleotide
  modified_base (26)..(26): c or methylated C nucleotide

SEQ ID NO: 14 - DNA, 35 bp, Artificial; identical to SEQ ID NO: 9
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide

SEQ ID NO: 15 - DNA, 34 bp, Artificial; identical to SEQ ID NO: 10
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide

SEQ ID NO: 16 - DNA, 19 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
gcgtccctcctagcgccgg

SEQ ID NO: 17 - DNA, 29 bp, Artificial
  synthetic oligonucleotide
cccgggggggctccctggtttctccggtc

SEQ ID NO: 18 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggg

SEQ ID NO: 19 - DNA, 26 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccggg

SEQ ID NO: 20 - DNA, 27 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccggg

SEQ ID NO: 21 - DNA, 28 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccggg

SEQ ID NO: 22 - DNA, 29 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
ggcctgggtgcgtccctcctagcgccggg

SEQ ID NO: 23 - DNA, 30 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccggg

SEQ ID NO: 24 - DNA, 26 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccggga

SEQ ID NO: 25 - DNA, 27 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaa

SEQ ID NO: 26 - DNA, 28 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaag

SEQ ID NO: 27 - DNA, 29 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaagc

SEQ ID NO: 28 - DNA, 30 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccgggaagct

SEQ ID NO: 29 - DNA, 27 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccggga

SEQ ID NO: 30 - DNA, 29 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccgggaa

SEQ ID NO: 31 - DNA, 31 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccgggaag

SEQ ID NO: 32 - DNA, 33 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
ggcctgggtgcgtccctcctagcgccgggaagc

SEQ ID NO: 33 - DNA, 35 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccgggaagct

SEQ ID NO: 34 - DNA, 25 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgcc

SEQ ID NO: 35 - DNA, 25 bp, Artificial
  synthetic oligonucleotide
  modified_base (13)..(13): c or methylated C nucleotide
  modified_base (25)..(25): c or methylated C nucleotide
caggcctgggtgcgtccctcctagc

SEQ ID NO: 36 - DNA, 25 bp, Artificial
  synthetic oligonucleotide
  modified_base (16)..(16): c or methylated C nucleotide
gcgcaggcctgggtgcgtccctcct

SEQ ID NO: 37 - DNA, 25 bp, Artificial
  synthetic oligonucleotide
  modified_base (19)..(19): c or methylated C nucleotide
ttcgcgcaggcctgggtgcgtccct

SEQ ID NO: 38 - DNA, 25 bp, Artificial
  synthetic oligonucleotide
  modified_base (22)..(22): c or methylated C nucleotide
ctcttcgcgcaggcctgggtgcgtc

SEQ ID NO: 39 - DNA, 25 bp, Artificial
  synthetic oligonucleotide
  modified_base (4)..(4): c or methylated C nucleotide
  modified_base (16)..(16): c or methylated C nucleotide
  modified_base (19)..(19): c or methylated C nucleotide
gtgcgtccctcctagcgccgggaag

SEQ ID NO: 40 - DNA, 25 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccgggaagctg

SEQ ID NO: 41 - DNA, 25 bp, Artificial
  synthetic oligonucleotide
  modified_base (10)..(10): c or methylated C nucleotide
  modified_base (13)..(13): c or methylated C nucleotide
ccctcctagcgccgggaagctgggt

SEQ ID NO: 42 - DNA, 25 bp, Artificial
  synthetic oligonucleotide
  modified_base (7)..(7): c or methylated C nucleotide
  modified_base (10)..(10): c or methylated C nucleotide
tcctagcgccgggaagctgggttgc

SEQ ID NO: 43 - DNA, 25 bp, Artificial
  synthetic oligonucleotide
  modified_base (4)..(4): c or methylated C nucleotide
  modified_base (7)..(7): c or methylated C nucleotide
tagcgccgggaagctgggttgcctg

SEQ ID NO: 44 - DNA, 23 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
ggtgcgtccctcctagcgccggg

SEQ ID NO: 45 - DNA, 21 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
tgcgtccctcctagcgccggg

SEQ ID NO: 46 - DNA, 19 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccggg

SEQ ID NO: 47 - DNA, 17 bp, Artificial
  synthetic oligonucleotide
  modified_base (11)..(11): c or methylated C nucleotide
  modified_base (14)..(14): c or methylated C nucleotide
tccctcctagcgccggg

SEQ ID NO: 48 - DNA, 15 bp, Artificial
  synthetic oligonucleotide
  modified_base (9)..(9): c or methylated C nucleotide
  modified_base (12)..(12): c or methylated C nucleotide
cctcctagcgccggg

SEQ ID NO: 49 - DNA, 23 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctagcgccg

SEQ ID NO: 50 - DNA, 21 bp, Artificial
  synthetic oligonucleotide
  modified_base (7)..(7): c or methylated C nucleotide
  modified_base (19)..(19): c or methylated C nucleotide
tgggtgcgtccctcctagcgc

SEQ ID NO: 51 - DNA, 19 bp, Artificial
  synthetic oligonucleotide
  modified_base (7)..(7): c or methylated C nucleotide
  modified_base (19)..(19): c or methylated C nucleotide
tgggtgcgtccctcctagc

SEQ ID NO: 52 - DNA, 17 bp, Artificial
  synthetic oligonucleotide
  modified_base (7)..(7): c or methylated C nucleotide
tgggtgcgtccctccta

SEQ ID NO: 53 - DNA, 15 bp, Artificial
  synthetic oligonucleotide
  modified_base (7)..(7): c or methylated C nucleotide
tgggtgcgtccctcc

SEQ ID NO: 54 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcatccctcctagcgccggg

SEQ ID NO: 55 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgtgtgcgtccctcctagcgccggg

SEQ ID NO: 56 - DNA, 25 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
tgggtgcgtccctcctaccgccggg

SEQ ID NO: 57 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccct

SEQ ID NO: 58 - DNA, 27 bp, Artificial
  synthetic oligonucleotide
  modified_base (4)..(4): c or methylated C nucleotide
  modified_base (7)..(7): c or methylated C nucleotide
  modified_base (21)..(21): c or methylated C nucleotide
cttcgccgcaggcctgggtgcgtccct

SEQ ID NO: 59 - DNA, 28 bp, Artificial
  synthetic oligonucleotide
  modified_base (5)..(5): c or methylated C nucleotide
  modified_base (8)..(8): c or methylated C nucleotide
  modified_base (22)..(22): c or methylated C nucleotide
tcttcgccgcaggcctgggtgcgtccct

SEQ ID NO: 60 - DNA, 29 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtccct

SEQ ID NO: 61 - DNA, 30 bp, Artificial
  synthetic oligonucleotide
  modified_base (7)..(7): c or methylated C nucleotide
  modified_base (10)..(10): c or methylated C nucleotide
  modified_base (24)..(24): c or methylated C nucleotide
tctcttcgccgcaggcctgggtgcgtccct

SEQ ID NO: 62 - DNA, 31 bp, Artificial
  synthetic oligonucleotide
  modified_base (8)..(8): c or methylated C nucleotide
  modified_base (11)..(11): c or methylated C nucleotide
  modified_base (25)..(25): c or methylated C nucleotide
ctctcttcgccgcaggcctgggtgcgtccct

SEQ ID NO: 63 - DNA, 27 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctc

SEQ ID NO: 64 - DNA, 28 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcc

SEQ ID NO: 65 - DNA, 29 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcct

SEQ ID NO: 66 - DNA, 30 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctccta

SEQ ID NO: 67 - DNA, 31 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtccctcctag

SEQ ID NO: 68 - DNA, 28 bp, Artificial
  synthetic oligonucleotide
  modified_base (4)..(4): c or methylated C nucleotide
  modified_base (7)..(7): c or methylated C nucleotide
  modified_base (21)..(21): c or methylated C nucleotide
cttcgccgcaggcctgggtgcgtccctc

SEQ ID NO: 69 - DNA, 30 bp, Artificial
  synthetic oligonucleotide
  modified_base (5)..(5): c or methylated C nucleotide
  modified_base (8)..(8): c or methylated C nucleotide
  modified_base (22)..(22): c or methylated C nucleotide
tcttcgccgcaggcctgggtgcgtccctcc

SEQ ID NO: 70 - DNA, 32 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtccctcct

SEQ ID NO: 71 - DNA, 34 bp, Artificial
  synthetic oligonucleotide
  modified_base (7)..(7): c or methylated C nucleotide
  modified_base (10)..(10): c or methylated C nucleotide
  modified_base (24)..(24): c or methylated C nucleotide
tctcttcgccgcaggcctgggtgcgtccctccta

SEQ ID NO: 72 - DNA, 36 bp, Artificial
  synthetic oligonucleotide
  modified_base (8)..(8): c or methylated C nucleotide
  modified_base (11)..(11): c or methylated C nucleotide
  modified_base (25)..(25): c or methylated C nucleotide
ctctcttcgccgcaggcctgggtgcgtccctcctag

SEQ ID NO: 73 - DNA, 26 bp, Artificial
  synthetic oligonucleotide
  modified_base (6)..(6): c or methylated C nucleotide
  modified_base (9)..(9): c or methylated C nucleotide
  modified_base (23)..(23): c or methylated C nucleotide
ctcttcgccgcaggcctgggtgcgtc

SEQ ID NO: 74 - DNA, 26 bp, Artificial
  synthetic oligonucleotide
  modified_base (9)..(9): c or methylated C nucleotide
  modified_base (12)..(12): c or methylated C nucleotide
  modified_base (26)..(26): c or methylated C nucleotide
cctctcttcgccgcaggcctgggtgc

SEQ ID NO: 75 - DNA, 26 bp, Artificial
  synthetic oligonucleotide
  modified_base (12)..(12): c or methylated C nucleotide
  modified_base (15)..(15): c or methylated C nucleotide
ctccctctcttcgccgcaggcctggg

SEQ ID NO: 76 - DNA, 26 bp, Artificial
  synthetic oligonucleotide
  modified_base (15)..(15): c or methylated C nucleotide
  modified_base (18)..(18): c or methylated C nucleotide
tttctccctctcttcgccgcaggcct

SEQ ID NO: 77 - DNA, 26 bp, Artificial
  synthetic oligonucleotide
  modified_base (18)..(18): c or methylated C nucleotide
  modified_base (21)..(21): c or methylated C nucleotide
cactttctccctctcttcgccgcagg

SEQ ID NO: 78 - DNA, 26 bp, Artificial
  synthetic oligonucleotide
  modified_base (3)..(3): c or methylated C nucleotide
  modified_base (17)..(17): c or methylated C nucleotide
gccgcaggcctgggtgcgtccctcct

SEQ ID NO: 79 - DNA, 26 bp, Artificial
  synthetic oligonucleotide
  modified_base (14)..(14): c or methylated C nucleotide
gcaggcctgggtgcgtccctcctagc

SEQ ID NO: 80 - DNA, 26 bp, Artificial
  synthetic oligonucleotide
  modified_base (11)..(11): c or methylated C nucleotide
ggcctgggtgcgtccctcctagcgcc

SEQ ID NO: 81 - DNA, 26 bp, Artificial
  synthetic oligonucleotide
  modified_base (8)..(8): c or methylated C nucleotide
ctgggtgcgtccctcctagcgccggg

SEQ ID NO: 82 - DNA, 26 bp, Artificial
  synthetic oligonucleotide
  modified_base (5)..(5): c or methylated C nucleotide
ggtgcgtccctcctagcgccgggaag

SEQ ID NO: 83 - DNA, 24 bp, Artificial
  synthetic oligonucleotide
  modified_base (1)..(1): c or methylated C nucleotide
  modified_base (4)..(4): c or methylated C nucleotide
  modified_base (18)..(18): c or methylated C nucleotide
cgccgcaggcctgggtgcgtccct

SEQ ID NO: 84 - DNA, 22 bp, Artificial
  synthetic oligonucleotide
  modified_base (2)..(2): c or methylated C nucleotide
  modified_base (16)..(16): c or methylated C nucleotide
ccgcaggcctgggtgcgtccct

SEQ ID NO: 85 - DNA, 20 bp, Artificial
  synthetic oligonucleotide
  modified_base (14)..(14): c or methylated C nucleotide
gcaggcctgggtgcgtccct

SEQ ID NO: 86 - DNA, 18 bp, Artificial
  synthetic oligonucleotide
  modified_base (12)..(12): c or methylated C nucleotide
aggcctgggtgcgtccct

SEQ ID NO: 87 - DNA, 16 bp, Artificial
  synthetic oligonucleotide
  modified_base (10)..(10): c or methylated C nucleotide
gcctgggtgcgtccct

SEQ ID NO: 88 - DNA, 15 bp, Artificial
  synthetic oligonucleotide
  modified_base (9)..(9): c or methylated C nucleotide
cctgggtgcgtccct

SEQ ID NO: 89 - DNA, 24 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtcc

SEQ ID NO: 90 - DNA, 22 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgt

SEQ ID NO: 91 - DNA, 20 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgc

SEQ ID NO: 92 - DNA, 18 bp, Artificial
  synthetic oligonucleotide
  modified_base (3)..(3): c or methylated C nucleotide
  modified_base (6)..(6): c or methylated C nucleotide
ttcgccgcaggcctgggt

SEQ ID NO: 93 - DNA, 16 bp, Artificial
  synthetic oligonucleotide
  modified_base (3)..(3): c or methylated C nucleotide
  modified_base (6)..(6): c or methylated C nucleotide
ttcgccgcaggcctgg

SEQ ID NO: 94 - DNA, 15 bp, Artificial
  synthetic oligonucleotide
  modified_base (3)..(3): c or methylated C nucleotide
  modified_base (6)..(6): c or methylated C nucleotide
ttcgccgcaggcctg

SEQ ID NO: 95 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcaccgcaggcctgggtgcgtccct

SEQ ID NO: 96 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgtgtgcgtccct

SEQ ID NO: 97 - DNA, 26 bp, Artificial
  synthetic oligonucleotide
  modified_base (3)..(3): c or methylated C nucleotide
  modified_base (6)..(6): c or methylated C nucleotide
  modified_base (20)..(20): c or methylated C nucleotide
ttcgccgcaggcctgggtgcgtacct

SEQ ID NO: 98 - DNA, 24 bp, Artificial
  synthetic oligonucleotide
  modified_base (13)..(13): c or methylated C nucleotide
  modified_base (20)..(20): c or methylated C nucleotide
tgccccctcccccggagtccggga

SEQ ID NO: 99 - DNA, 25 bp, Artificial
  synthetic oligonucleotide
  modified_base (14)..(14): c or methylated C nucleotide
  modified_base (21)..(21): c or methylated C nucleotide
ctgccccctcccccggagtccggga

SEQ ID NO: 100 - DNA, 26 bp, Artificial
  synthetic oligonucleotide
  modified_base (15)..(15): c or methylated C nucleotide
  modified_base (22)..(22): c or methylated C nucleotide
tctgccccctcccccggagtccggga

SEQ ID NO: 101 - DNA, 27 bp, Artificial
  synthetic oligonucleotide
  modified_base (16)..(16): c or methylated C nucleotide
  modified_base (23)..(23): c or methylated C nucleotide
ctctgccccctcccccggagtccggga

SEQ ID NO: 102 - DNA, 28 bp, Artificial
  synthetic oligonucleotide
  modified_base (17)..(17): c or methylated C nucleotide
  modified_base (24)..(24): c or methylated C nucleotide
actctgccccctcccccggagtccggga

SEQ ID NO: 103 - DNA, 29 bp, Artificial
  synthetic oligonucleotide
  modified_base (18)..(18): c or methylated C nucleotide
  modified_base (25)..(25): c or methylated C nucleotide
gactctgccccctcccccggagtccggga

SEQ ID NO: 104 - DNA, 25 bp, Artificial
  synthetic oligonucleotide
  modified_base (13)..(13): c or methylated C nucleotide
  modified_base (20)..(20): c or methylated C nucleotide
tgccccctcccccggagtccgggat

SEQ ID NO: 105 - DNA, 26 bp, Artificial
  synthetic oligonucleotide
  modified_base (13)..(13): c or methylated C nucleotide
  modified_base (20)..(20): c or methylated C nucleotide
tgccccctcccccggagtccgggata

SEQ ID NO: 106 - DNA, 27 bp, Artificial
  synthetic oligonucleotide
  modified_base (13)..(13): c or methylated C nucleotide
  modified_base (20)..(20): c or methylated C nucleotide
tgccccctcccccggagtccgggataa

SEQ ID NO: 107 - DNA, 28 bp, Artificial
  synthetic oligonucleotide
  modified_base (13)..(13): c or methylated C nucleotide
  modified_base (20)..(20): c or methylated C nucleotide
tgccccctcccccggagtccgggataaa

SEQ ID NO: 108 - DNA, 29 bp, Artificial
  synthetic oligonucleotide
  modified_base (13)..(13): c or methylated C nucleotide
  modified_base (20)..(20): c or methylated C nucleotide
tgccccctcccccggagtccgggataaat

SEQ ID NO: 109 - DNA, 26 bp, Artificial
  synthetic oligonucleotide
  modified_base (14)..(14): c or methylated C nucleotide
  modified_base (21)..(21): c or methylated C nucleotide
ctgccccctcccccggagtccgggat

SEQ ID NO: 110 - DNA, 28 bp, Artificial
  synthetic oligonucleotide
  modified_base (15)..(15): c or methylated C nucleotide
  modified_base (22)..(22): c or methylated C nucleotide
tctgccccctcccccggagtccgggata

SEQ ID NO: 111 - DNA, 30 bp, Artificial
  synthetic oligonucleotide
  modified_base (16)..(16): c or methylated C nucleotide
  modified_base (23)..(23): c or methylated C nucleotide
ctctgccccctcccccggagtccgggataa

SEQ ID NO: 112 - DNA, 32 bp, Artificial
  synthetic oligonucleotide
  modified_base (17)..(17): c or methylated C nucleotide
  modified_base (24)..(24): c or methylated C nucleotide
actctgccccctcccccggagtccgggataaa

SEQ ID NO: 113 - DNA, 34 bp, Artificial
  synthetic oligonucleotide
  modified_base (18)..(18): c or methylated C nucleotide
  modified_base (25)..(25): c or methylated C nucleotide
gactctgccccctcccccggagtccgggataaat

SEQ ID NO: 114 - DNA, 24 bp, Artificial
  synthetic oligonucleotide
  modified_base (16)..(16): c or methylated C nucleotide
  modified_base (23)..(23): c or methylated C nucleotide
ctctgccccctcccccggagtccg

SEQ ID NO: 115 - DNA, 24 bp, Artificial
  synthetic oligonucleotide
  modified_base (19)..(19): c or methylated C nucleotide
tgactctgccccctcccccggagt

SEQ ID NO: 116 - DNA, 24 bp, Artificial
  synthetic oligonucleotide
  modified_base (22)..(22): c or methylated C nucleotide
tggtgactctgccccctcccccgg

SEQ ID NO: 117 - DNA, 24 bp, Artificial
  synthetic oligonucleotide
ggctggtgactctgccccctcccc

SEQ ID NO: 118 - DNA, 24 bp, Artificial
  synthetic oligonucleotide
agaggctggtgactctgccccctc

SEQ ID NO: 119 - DNA, 24 bp, Artificial
  synthetic oligonucleotide
  modified_base (10)..(10): c or methylated C nucleotide
  modified_base (17)..(17): c or methylated C nucleotide
cccctcccccggagtccgggataa

SEQ ID NO: 120 - DNA, 24 bp, Artificial
  synthetic oligonucleotide
  modified_base (7)..(7): c or methylated C nucleotide
  modified_base (14)..(14): c or methylated C nucleotide
ctcccccggagtccgggataaatt

SEQ ID NO: 121 - DNA, 24 bp, Artificial
  synthetic oligonucleotide
  modified_base (4)..(4): c or methylated C nucleotide
  modified_base (11)..(11): c or methylated C nucleotide
ccccggagtccgggataaattccc

SEQ ID NO: 122 - DNA, 24 bp, Artificial
  synthetic oligonucleotide
  modified_base (1)..(1): c or methylated C nucleotide
  modified_base (8)..(8): c or methylated C nucleotide
cggagtccgggataaattccctag

SEQ ID NO: 123 - DNA, 24 bp, Artificial
  synthetic oligonucleotide
  modified_base (5)..(5): c or methylated C nucleotide
agtccgggataaattccctaggct

SEQ ID NO: 124 - DNA, 22 bp, Artificial
  synthetic oligonucleotide
  modified_base (11)..(11): c or methylated C nucleotide
  modified_base (18)..(18): c or methylated C nucleotide
ccccctcccccggagtccggga

SEQ ID NO: 125 - DNA, 20 bp, Artificial
  synthetic oligonucleotide
  modified_base (9)..(9): c or methylated C nucleotide
  modified_base (16)..(16): c or methylated C nucleotide
ccctcccccggagtccggga

SEQ ID NO: 126 - DNA, 18 bp, Artificial
  synthetic oligonucleotide
  modified_base (7)..(7): c or methylated C nucleotide
  modified_base (14)..(14): c or methylated C nucleotide
ctcccccggagtccggga

SEQ ID NO: 127 - DNA, 16 bp, Artificial
  synthetic oligonucleotide
  modified_base (5)..(5): c or methylated C nucleotide
  modified_base (12)..(12): c or methylated C nucleotide
cccccggagtccggga

SEQ ID NO: 128 - DNA, 15 bp, Artificial
  synthetic oligonucleotide
  modified_base (4)..(4): c or methylated C nucleotide
  modified_base (11)..(11): c or methylated C nucleotide
ccccggagtccggga

SEQ ID NO: 129 - DNA, 22 bp, Artificial
  synthetic oligonucleotide
  modified_base (13)..(13): c or methylated C nucleotide
  modified_base (20)..(20): c or methylated C nucleotide
tgccccctcccccggagtccgg

SEQ ID NO: 130 - DNA, 20 bp, Artificial
  synthetic oligonucleotide
  modified_base (13)..(13): c or methylated C nucleotide
  modified_base (20)..(20): c or methylated C nucleotide
tgccccctcccccggagtcc

SEQ ID NO: 131 - DNA, 18 bp, Artificial
  synthetic oligonucleotide
  modified_base (13)..(13): c or methylated C nucleotide
tgccccctcccccggagt

SEQ ID NO: 132 - DNA, 16 bp, Artificial
  synthetic oligonucleotide
  modified_base (13)..(13): c or methylated C nucleotide
tgccccctcccccgga

SEQ ID NO: 133 - DNA, 15 bp, Artificial
  synthetic oligonucleotide
  modified_base (13)..(13): c or methylated C nucleotide
tgccccctcccccgg

SEQ ID NO: 134 - DNA, 24 bp, Artificial
  synthetic oligonucleotide
  modified_base (13)..(13): c or methylated C nucleotide
  modified_base (20)..(20): c or methylated C nucleotide
tgccccctctcccggagtccggga

SEQ ID NO: 135 - DNA, 24 bp, Artificial
  synthetic oligonucleotide
  modified_base (13)..(13): c or methylated C nucleotide
  modified_base (20)..(20): c or methylated C nucleotide
tgccccctcccccggagtacggga

SEQ ID NO: 136 - DNA, 24 bp, Artificial
  synthetic oligonucleotide
  modified_base (13)..(13): c or methylated C nucleotide
  modified_base (20)..(20): c or methylated C nucleotide
tgcccgctcccccggagtccggga

SEQ ID NO: 137 - DNA, 33 bp, Artificial; identical to SEQ ID NO: 8
  synthetic oligonucleotide
  modified_base (13)..(13): c or methylated C nucleotide
  modified_base (15)..(15): c or methylated C nucleotide
  modified_base (26)..(26): c or methylated C nucleotide

SEQ ID NO: 138 - DNA, 34 bp, Artificial
  synthetic oligonucleotide
  modified_base (14)..(14): c or methylated C nucleotide
  modified_base (16)..(16): c or methylated C nucleotide
  modified_base (27)..(27): c or methylated C nucleotide
gattgggagcaagcgcgctcccagctcgccccct

SEQ ID NO: 139 - DNA, 35 bp, Artificial
  synthetic oligonucleotide
  modified_base (15)..(15): c or methylated C nucleotide
  modified_base (17)..(17): c or methylated C nucleotide
  modified_base (28)..(28): c or methylated C nucleotide
tgattgggagcaagcgcgctcccagctcgccccct

SEQ ID NO: 140 - DNA, 36 bp, Artificial
  synthetic oligonucleotide
  modified_base (16)..(16): c or methylated C nucleotide
  modified_base (18)..(18): c or methylated C nucleotide
  modified_base (29)..(29): c or methylated C nucleotide
gtgattgggagcaagcgcgctcccagctcgccccct

SEQ ID NO: 141 - DNA, 37 bp, Artificial
  synthetic oligonucleotide
  modified_base (17)..(17): c or methylated C nucleotide
  modified_base (19)..(19): c or methylated C nucleotide
  modified_base (30)..(30): c or methylated C nucleotide
tgtgattgggagcaagcgcgctcccagctcgccccct

SEQ ID NO: 142 - DNA, 38 bp, Artificial
  synthetic oligonucleotide
  modified_base (18)..(18): c or methylated C nucleotide
  modified_base (20)..(20): c or methylated C nucleotide
  modified_base (31)..(31): c or methylated C nucleotide
ctgtgattgggagcaagcgcgctcccagctcgccccct

SEQ ID NO: 143 - DNA, 34 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctc

SEQ ID NO: 144 - DNA, 35 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctcc

SEQ ID NO: 145 - DNA, 36 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctcca

SEQ ID NO: 146 - DNA, 37 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctccaa

SEQ ID NO: 147 - DNA, 38 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgccccctccaac

SEQ ID NO: 148 - DNA, 35 bp, Artificial
  synthetic oligonucleotide
gattgggagcaagcgcgctcccagctcgccccctc

SEQ ID NO: 149 - DNA, 37 bp, Artificial
  synthetic oligonucleotide
tgattgggagcaagcgcgctcccagctcgccccctcc

SEQ ID NO: 150 - DNA, 39 bp, Artificial
  synthetic oligonucleotide
gtgattgggagcaagcgcgctcccagctcgccccctcca

SEQ ID NO: 151 - DNA, 41 bp, Artificial
  synthetic oligonucleotide
tgtgattgggagcaagcgcgctcccagctcgccccctccaa

SEQ ID NO: 152 - DNA, 43 bp, Artificial
  synthetic oligonucleotide
ctgtgattgggagcaagcgcgctcccagctcgccccctccaac

SEQ ID NO: 153 - DNA, 33 bp, Artificial
  synthetic oligonucleotide
  modified_base (16)..(16): c or methylated C nucleotide
  modified_base (18)..(18): c or methylated C nucleotide
  modified_base (29)..(29): c or methylated C nucleotide
gtgattgggagcaagcgcgctcccagctcgccc

SEQ ID NO: 154 - DNA, 33 bp, Artificial
  synthetic oligonucleotide
  modified_base (19)..(19): c or methylated C nucleotide
  modified_base (21)..(21): c or methylated C nucleotide
  modified_base (32)..(32): c or methylated C nucleotide
cctgtgattgggagcaagcgcgctcccagctcg

SEQ ID NO: 155 - DNA, 33 bp, Artificial
  synthetic oligonucleotide
  modified_base (22)..(22): c or methylated C nucleotide
  modified_base (24)..(24): c or methylated C nucleotide
tctcctgtgattgggagcaagcgcgctcccagc

SEQ ID NO: 156 - DNA, 33 bp, Artificial
  synthetic oligonucleotide
  modified_base (25)..(25): c or methylated C nucleotide
  modified_base (27)..(27): c or methylated C nucleotide
ccttctcctgtgattgggagcaagcgcgctccc

SEQ ID NO: 157 - DNA, 33 bp, Artificial
  synthetic oligonucleotide
  modified_base (28)..(28): c or methylated C nucleotide
  modified_base (30)..(30): c or methylated C nucleotide
cctccttctcctgtgattgggagcaagcgcgct

SEQ ID NO: 158 - DNA, 33 bp, Artificial
  synthetic oligonucleotide
  modified_base (10)..(10): c or methylated C nucleotide
  modified_base (12)..(12): c or methylated C nucleotide
  modified_base (23)..(23): c or methylated C nucleotide
gggagcaagcgcgctcccagctcgccccctcca

SEQ ID NO: 159 - DNA, 33 bp, Artificial
  synthetic oligonucleotide
  modified_base (7)..(7): c or methylated C nucleotide
  modified_base (9)..(9): c or methylated C nucleotide
  modified_base (20)..(20): c or methylated C nucleotide
agcaagcgcgctcccagctcgccccctccaact

SEQ ID NO: 160 - DNA, 33 bp, Artificial
  synthetic oligonucleotide
  modified_base (4)..(4): c or methylated C nucleotide
  modified_base (6)..(6): c or methylated C nucleotide
  modified_base (17)..(17): c or methylated C nucleotide
aagcgcgctcccagctcgccccctccaactgca

SEQ ID NO: 161 - DNA, 33 bp, Artificial
  synthetic oligonucleotide
  modified_base (1)..(1): c or methylated C nucleotide
  modified_base (3)..(3): c or methylated C nucleotide
  modified_base (14)..(14): c or methylated C nucleotide
cgcgctcccagctcgccccctccaactgcattc

SEQ ID NO: 162 - DNA, 33 bp, Artificial
  synthetic oligonucleotide
  modified_base (11)..(11): c or methylated C nucleotide
gctcccagctcgccccctccaactgcattccaa

SEQ ID NO: 163 - DNA, 31 bp, Artificial
  synthetic oligonucleotide
  modified_base (11)..(11): c or methylated C nucleotide
  modified_base (13)..(13): c or methylated C nucleotide
  modified_base (24)..(24): c or methylated C nucleotide
tgggagcaagcgcgctcccagctcgccccct

SEQ ID NO: 164 - DNA, 29 bp, Artificial
  synthetic oligonucleotide
  modified_base (9)..(9): c or methylated C nucleotide
  modified_base (11)..(11): c or methylated C nucleotide
  modified_base (22)..(22): c or methylated C nucleotide
ggagcaagcgcgctcccagctcgccccct

SEQ ID NO: 165 - DNA, 27 bp, Artificial
  synthetic oligonucleotide
  modified_base (7)..(7): c or methylated C nucleotide
  modified_base (9)..(9): c or methylated C nucleotide
  modified_base (20)..(20): c or methylated C nucleotide
agcaagcgcgctcccagctcgccccct

SEQ ID NO: 166 - DNA, 25 bp, Artificial
  synthetic oligonucleotide
  modified_base (5)..(5): c or methylated C nucleotide
  modified_base (7)..(7): c or methylated C nucleotide
  modified_base (18)..(18): c or methylated C nucleotide
caagcgcgctcccagctcgccccct

SEQ ID NO: 167 - DNA, 23 bp, Artificial
  synthetic oligonucleotide
  modified_base (3)..(3): c or methylated C nucleotide
  modified_base (5)..(5): c or methylated C nucleotide
  modified_base (16)..(16): c or methylated C nucleotide
agcgcgctcccagctcgccccct

SEQ ID NO: 168 - DNA, 21 bp, Artificial
  synthetic oligonucleotide
  modified_base (1)..(1): c or methylated C nucleotide
  modified_base (3)..(3): c or methylated C nucleotide
  modified_base (14)..(14): c or methylated C nucleotide
cgcgctcccagctcgccccct

SEQ ID NO: 169 - DNA, 19 bp, Artificial
  synthetic oligonucleotide
  modified_base (1)..(1): c or methylated C nucleotide
  modified_base (12)..(12): c or methylated C nucleotide
cgctcccagctcgccccct

SEQ ID NO: 170 - DNA, 17 bp, Artificial
  synthetic oligonucleotide
  modified_base (10)..(10): c or methylated C nucleotide
ctcccagctcgccccct

SEQ ID NO: 171 - DNA, 15 bp, Artificial
  synthetic oligonucleotide
  modified_base (8)..(8): c or methylated C nucleotide
cccagctcgccccct

SEQ ID NO: 172 - DNA, 31 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgcccc

SEQ ID NO: 173 - DNA, 29 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcgcc

SEQ ID NO: 174 - DNA, 27 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctcccagctcg

SEQ ID NO: 175 - DNA, 25 bp, Artificial
  synthetic oligonucleotide
  modified_base (13)..(13): c or methylated C nucleotide
  modified_base (15)..(15): c or methylated C nucleotide
attgggagcaagcgcgctcccagct

SEQ ID NO: 176 - DNA, 23 bp, Artificial
  synthetic oligonucleotide
  modified_base (13)..(13): c or methylated C nucleotide
  modified_base (15)..(15): c or methylated C nucleotide
attgggagcaagcgcgctcccag

SEQ ID NO: 177 - DNA, 21 bp, Artificial
  synthetic oligonucleotide
  modified_base (13)..(13): c or methylated C nucleotide
  modified_base (15)..(15): c or methylated C nucleotide
attgggagcaagcgcgctccc

SEQ ID NO: 178 - DNA, 19 bp, Artificial
  synthetic oligonucleotide
  modified_base (13)..(13): c or methylated C nucleotide
  modified_base (15)..(15): c or methylated C nucleotide
attgggagcaagcgcgctc

SEQ ID NO: 179 - DNA, 17 bp, Artificial
  synthetic oligonucleotide
  modified_base (13)..(13): c or methylated C nucleotide
  modified_base (15)..(15): c or methylated C nucleotide
attgggagcaagcgcgc

SEQ ID NO: 180 - DNA, 15 bp, Artificial
  synthetic oligonucleotide
  modified_base (13)..(13): c or methylated C nucleotide
  modified_base (15)..(15): c or methylated C nucleotide
attgggagcaagcgc

SEQ ID NO: 181 - DNA, 33 bp, Artificial
  synthetic oligonucleotide
  modified_base (13)..(13)
  modified_base (15)..(15)
  modified_base (26)..(26)
gttgggagcaagcgcgctcccagctcgccccct

SEQ ID NO: 182 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcaagcgcgctccctgctcgccccct

SEQ ID NO: 183 - DNA, 33 bp, Artificial
  synthetic oligonucleotide
  modified_base (13)..(13): c or methylated C nucleotide
  modified_base (15)..(15): c or methylated C nucleotide
  modified_base (26)..(26): c or methylated C nucleotide
attgggagcacgcgcgctcccagctcgccccct

SEQ ID NO: 184 - DNA, 35 bp, Artificial; identical to SEQ ID NO: 9
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide

SEQ ID NO: 185 - DNA, 36 bp, Artificial
  synthetic oligonucleotide
  modified_base (3)..(3): c or methylated C nucleotide
  modified_base (5)..(5): c or methylated C nucleotide
  modified_base (19)..(19): c or methylated C nucleotide
  modified_base (31)..(31): c or methylated C nucleotide
  modified_base (34)..(34): c or methylated C nucleotide
ttcgcgcaggcctgggtgcgtccctcctagcgccgg

SEQ ID NO: 186 - DNA, 37 bp, Artificial
  synthetic oligonucleotide
  modified_base (4)..(4): c or methylated C nucleotide
  modified_base (6)..(6): c or methylated C nucleotide
  modified_base (20)..(20): c or methylated C nucleotide
  modified_base (32)..(32): c or methylated C nucleotide
  modified_base (35)..(35): c or methylated C nucleotide
cttcgcgcaggcctgggtgcgtccctcctagcgccgg

SEQ ID NO: 187 - DNA, 38 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
  modified_base (36)..(36): c or methylated C nucleotide
tcttcgcgcaggcctgggtgcgtccctcctagcgccgg

SEQ ID NO: 188 - DNA, 39 bp, Artificial
  synthetic oligonucleotide
  modified_base (6)..(6): c or methylated C nucleotide
  modified_base (8)..(8): c or methylated C nucleotide
  modified_base (22)..(22): c or methylated C nucleotide
  modified_base (34)..(34): c or methylated C nucleotide
  modified_base (37)..(37): c or methylated C nucleotide
ctcttcgcgcaggcctgggtgcgtccctcctagcgccgg

SEQ ID NO: 189 - DNA, 40 bp, Artificial
  synthetic oligonucleotide
  modified_base (7)..(7): c or methylated C nucleotide
  modified_base (9)..(9): c or methylated C nucleotide
  modified_base (23)..(23): c or methylated C nucleotide
  modified_base (35)..(35): c or methylated C nucleotide
  modified_base (38)..(38): c or methylated C nucleotide
tctcttcgcgcaggcctgggtgcgtccctcctagcgccgg

SEQ ID NO: 190 - DNA, 36 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccggg

SEQ ID NO: 191 - DNA, 37 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccggga

SEQ ID NO: 192 - DNA, 38 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaa

SEQ ID NO: 193 - DNA, 39 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaag

SEQ ID NO: 194 - DNA, 40 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgccgggaagc

SEQ ID NO: 195 - DNA, 37 bp, Artificial
  synthetic oligonucleotide
  modified_base (3)..(3): c or methylated C nucleotide
  modified_base (5)..(5): c or methylated C nucleotide
  modified_base (19)..(19): c or methylated C nucleotide
  modified_base (31)..(31): c or methylated C nucleotide
  modified_base (34)..(34): c or methylated C nucleotide
ttcgcgcaggcctgggtgcgtccctcctagcgccggg

SEQ ID NO: 196 - DNA, 39 bp, Artificial
  synthetic oligonucleotide
  modified_base (4)..(4): c or methylated C nucleotide
  modified_base (6)..(6): c or methylated C nucleotide
  modified_base (20)..(20): c or methylated C nucleotide
  modified_base (32)..(32): c or methylated C nucleotide
  modified_base (35)..(35): c or methylated C nucleotide
cttcgcgcaggcctgggtgcgtccctcctagcgccggga

SEQ ID NO: 197 - DNA, 41 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
  modified_base (36)..(36): c or methylated C nucleotide
tcttcgcgcaggcctgggtgcgtccctcctagcgccgggaa

SEQ ID NO: 198 - DNA, 43 bp, Artificial
  synthetic oligonucleotide
  modified_base (6)..(6): c or methylated C nucleotide
  modified_base (8)..(8): c or methylated C nucleotide
  modified_base (22)..(22): c or methylated C nucleotide
  modified_base (34)..(34): c or methylated C nucleotide
  modified_base (37)..(37): c or methylated C nucleotide
ctcttcgcgcaggcctgggtgcgtccctcctagcgccgggaag

SEQ ID NO: 199 - DNA, 45 bp, Artificial
  synthetic oligonucleotide
  modified_base (7)..(7): c or methylated C nucleotide
  modified_base (9)..(9): c or methylated C nucleotide
  modified_base (23)..(23): c or methylated C nucleotide
  modified_base (35)..(35): c or methylated C nucleotide
  modified_base (38)..(38): c or methylated C nucleotide
tctcttcgcgcaggcctgggtgcgtccctcctagcgccgggaagc

SEQ ID NO: 200 - DNA, 35 bp, Artificial
  synthetic oligonucleotide
  modified_base (5)..(5): c or methylated C nucleotide
  modified_base (7)..(7): c or methylated C nucleotide
  modified_base (21)..(21): c or methylated C nucleotide
  modified_base (33)..(33): c or methylated C nucleotide
tcttcgcgcaggcctgggtgcgtccctcctagcgc

SEQ ID NO: 201 - DNA, 35 bp, Artificial
  synthetic oligonucleotide
  modified_base (8)..(8): c or methylated C nucleotide
  modified_base (10)..(10): c or methylated C nucleotide
  modified_base (24)..(24): c or methylated C nucleotide
ctctcttcgcgcaggcctgggtgcgtccctcctag

SEQ ID NO: 202 - DNA, 35 bp, Artificial
  synthetic oligonucleotide
  modified_base (11)..(11): c or methylated C nucleotide
  modified_base (13)..(13): c or methylated C nucleotide
  modified_base (27)..(27): c or methylated C nucleotide
tccctctcttcgcgcaggcctgggtgcgtccctcc

SEQ ID NO: 203 - DNA, 35 bp, Artificial
  synthetic oligonucleotide
  modified_base (14)..(14): c or methylated C nucleotide
  modified_base (16)..(16): c or methylated C nucleotide
  modified_base (30)..(30): c or methylated C nucleotide
ttctccctctcttcgcgcaggcctgggtgcgtccc

SEQ ID NO: 204 - DNA, 35 bp, Artificial
  synthetic oligonucleotide
  modified_base (17)..(17): c or methylated C nucleotide
  modified_base (19)..(19): c or methylated C nucleotide
  modified_base (33)..(33): c or methylated C nucleotide
actttctccctctcttcgcgcaggcctgggtgcgt

SEQ ID NO: 205 - DNA, 35 bp, Artificial
  synthetic oligonucleotide
  modified_base (1)..(1): c or methylated C nucleotide
  modified_base (15)..(15): c or methylated C nucleotide
  modified_base (27)..(27): c or methylated C nucleotide
  modified_base (30)..(30): c or methylated C nucleotide
cgcaggcctgggtgcgtccctcctagcgccgggaa

SEQ ID NO: 206 - DNA, 35 bp, Artificial; identical to SEQ ID NO: 33
  synthetic oligonucleotide
  modified_base (12)..(12): c or methylated C nucleotide
  modified_base (24)..(24): c or methylated C nucleotide
  modified_base (27)..(27): c or methylated C nucleotide

SEQ ID NO: 207 - DNA, 35 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
cctgggtgcgtccctcctagcgccgggaagctggg

SEQ ID NO: 208 - DNA, 35 bp, Artificial
  synthetic oligonucleotide
  modified_base (6)..(6): c or methylated C nucleotide
  modified_base (18)..(18): c or methylated C nucleotide
  modified_base (21)..(21): c or methylated C nucleotide
gggtgcgtccctcctagcgccgggaagctgggttg

SEQ ID NO: 209 - DNA, 35 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
tgcgtccctcctagcgccgggaagctgggttgcct

SEQ ID NO: 210 - DNA, 33 bp, Artificial
  synthetic oligonucleotide
  modified_base (2)..(2): c or methylated C nucleotide
  modified_base (16)..(16): c or methylated C nucleotide
  modified_base (28)..(28): c or methylated C nucleotide
  modified_base (31)..(31): c or methylated C nucleotide
gcgcaggcctgggtgcgtccctcctagcgccgg

SEQ ID NO: 211 - DNA, 31 bp, Artificial
  synthetic oligonucleotide
  modified_base (14)..(14): c or methylated C nucleotide
  modified_base (26)..(26): c or methylated C nucleotide
  modified_base (29)..(29): c or methylated C nucleotide
gcaggcctgggtgcgtccctcctagcgccgg

SEQ ID NO: 212 - DNA, 29 bp, Artificial
  synthetic oligonucleotide
  modified_base (12)..(12): c or methylated C nucleotide
  modified_base (24)..(24): c or methylated C nucleotide
  modified_base (27)..(27): c or methylated C nucleotide
aggcctgggtgcgtccctcctagcgccgg

SEQ ID NO: 213 - DNA, 27 bp, Artificial
  synthetic oligonucleotide
  modified_base (10)..(10): c or methylated C nucleotide
  modified_base (22)..(22): c or methylated C nucleotide
  modified_base (25)..(25): c or methylated C nucleotide
gcctgggtgcgtccctcctagcgccgg

SEQ ID NO: 214 - DNA, 25 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
ctgggtgcgtccctcctagcgccgg

SEQ ID NO: 215 - DNA, 23 bp, Artificial
  synthetic oligonucleotide
  modified_base (6)..(6): c or methylated C nucleotide
  modified_base (18)..(18): c or methylated C nucleotide
  modified_base (21)..(21): c or methylated C nucleotide
gggtgcgtccctcctagcgccgg

SEQ ID NO: 216 - DNA, 21 bp, Artificial
  synthetic oligonucleotide
  modified_base (4)..(4): c or methylated C nucleotide
  modified_base (16)..(16): c or methylated C nucleotide
  modified_base (19)..(19): c or methylated C nucleotide
gtgcgtccctcctagcgccgg

SEQ ID NO: 217 - DNA, 19 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
gcgtccctcctagcgccgg

SEQ ID NO: 218 - DNA, 17 bp, Artificial
  synthetic oligonucleotide
  modified_base (12)..(12): c or methylated C nucleotide
  modified_base (15)..(15): c or methylated C nucleotide
gtccctcctagcgccgg

SEQ ID NO: 219 - DNA, 15 bp, Artificial
  synthetic oligonucleotide
  modified_base (10)..(10): c or methylated C nucleotide
  modified_base (13)..(13): c or methylated C nucleotide
ccctcctagcgccgg

SEQ ID NO: 220 - DNA, 33 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctcctagcgcc

SEQ ID NO: 221 - DNA, 31 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
tcgcgcaggcctgggtgcgtccctcctagcg

SEQ ID NO: 222 - DNA, 29 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctcctag

SEQ ID NO: 223 - DNA, 27 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctcct

SEQ ID NO: 224 - DNA, 25 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccctc

SEQ ID NO: 225 - DNA, 23 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcgtccc

SEQ ID NO: 226 - DNA, 19 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tggcaggcctgggtgcgtc

SEQ ID NO: 227 - DNA, 19 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
tcgcgcaggcctgggtgcg

SEQ ID NO: 228 - DNA, 17 bp, Artificial
  synthetic oligonucleotide
  modified_base (2)..(2): c or methylated C nucleotide
  modified_base (4)..(4): c or methylated C nucleotide
tcgcgcaggcctgggtg

SEQ ID NO: 229 - DNA, 15 bp, Artificial
  synthetic oligonucleotide
  modified_base (2)..(2): c or methylated C nucleotide
  modified_base (4)..(4): c or methylated C nucleotide
tcgcgcaggcctggg

SEQ ID NO: 230 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcacaggcctgggtgcgtccctcctagcgccgg

SEQ ID NO: 231 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgcccctcctagcgccgg

SEQ ID NO: 232 - DNA, 35 bp, Artificial
  synthetic oligonucleotide
  modified_base (2)..(2): c or methylated C nucleotide
  modified_base (4)..(4): c or methylated C nucleotide
  modified_base (18)..(18): c or methylated C nucleotide
  modified_base (30)..(30): c or methylated C nucleotide
  modified_base (33)..(33): c or methylated C nucleotide
tcgcgcaggcctgggtgcgtccctccgagcgccgg

SEQ ID NO: 233 - DNA, 34 bp, Artificial; identical to SEQ ID NO: 10
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide

SEQ ID NO: 234 - DNA, 35 bp, Artificial
  synthetic oligonucleotide
  modified_base (3)..(3): c or methylated C nucleotide
  modified_base (5)..(5): c or methylated C nucleotide
  modified_base (18)..(18): c or methylated C nucleotide
  modified_base (30)..(30): c or methylated C nucleotide
  modified_base (33)..(33): c or methylated C nucleotide
ttcgcgcaggcctgggtcgtccctcctagcgccgg

SEQ ID NO: 235 - DNA, 36 bp, Artificial
  synthetic oligonucleotide
  modified_base (4)..(4): c or methylated C nucleotide
  modified_base (6)..(6): c or methylated C nucleotide
  modified_base (19)..(19): c or methylated C nucleotide
  modified_base (31)..(31): c or methylated C nucleotide
  modified_base (34)..(34): c or methylated C nucleotide
cttcgcgcaggcctgggtcgtccctcctagcgccgg

SEQ ID NO: 236 - DNA, 37 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
  modified_base (35)..(35): c or methylated C nucleotide
tcttcgcgcaggcctgggtcgtccctcctagcgccgg

SEQ ID NO: 237 - DNA, 38 bp, Artificial
  synthetic oligonucleotide
  modified_base (6)..(6): c or methylated C nucleotide
  modified_base (8)..(8): c or methylated C nucleotide
  modified_base (21)..(21): c or methylated C nucleotide
  modified_base (33)..(33): c or methylated C nucleotide
  modified_base (36)..(36): c or methylated C nucleotide
ctcttcgcgcaggcctgggtcgtccctcctagcgccgg

SEQ ID NO: 238 - DNA, 39 bp, Artificial
  synthetic oligonucleotide
  modified_base (7)..(7): c or methylated C nucleotide
  modified_base (9)..(9): c or methylated C nucleotide
  modified_base (22)..(22): c or methylated C nucleotide
  modified_base (34)..(34): c or methylated C nucleotide
  modified_base (37)..(37): c or methylated C nucleotide
tctcttcgcgcaggcctgggtcgtccctcctagcgccgg

SEQ ID NO: 239 - DNA, 35 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccggg

SEQ ID NO: 240 - DNA, 36 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccggga

SEQ ID NO: 241 - DNA, 37 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaa

SEQ ID NO: 242 - DNA, 38 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaag

SEQ ID NO: 243 - DNA, 39 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgccgggaagc

SEQ ID NO: 244 - DNA, 36 bp, Artificial
  synthetic oligonucleotide
  modified_base (3)..(3): c or methylated C nucleotide
  modified_base (5)..(5): c or methylated C nucleotide
  modified_base (18)..(18): c or methylated C nucleotide
  modified_base (30)..(30): c or methylated C nucleotide
  modified_base (33)..(33): c or methylated C nucleotide
ttcgcgcaggcctgggtcgtccctcctagcgccggg

SEQ ID NO: 245 - DNA, 38 bp, Artificial
  synthetic oligonucleotide
  modified_base (4)..(4): c or methylated C nucleotide
  modified_base (6)..(6): c or methylated C nucleotide
  modified_base (19)..(19): c or methylated C nucleotide
  modified_base (31)..(31): c or methylated C nucleotide
  modified_base (34)..(34): c or methylated C nucleotide
cttcgcgcaggcctgggtcgtccctcctagcgccggga

SEQ ID NO: 246 - DNA, 40 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
  modified_base (35)..(35): c or methylated C nucleotide
tcttcgcgcaggcctgggtcgtccctcctagcgccgggaa

SEQ ID NO: 247 - DNA, 42 bp, Artificial
  synthetic oligonucleotide
  modified_base (6)..(6): c or methylated C nucleotide
  modified_base (8)..(8): c or methylated C nucleotide
  modified_base (21)..(21): c or methylated C nucleotide
  modified_base (33)..(33): c or methylated C nucleotide
  modified_base (36)..(36): c or methylated C nucleotide
ctcttcgcgcaggcctgggtcgtccctcctagcgccgggaag

SEQ ID NO: 248 - DNA, 44 bp, Artificial
  synthetic oligonucleotide
  modified_base (7)..(7): c or methylated C nucleotide
  modified_base (9)..(9): c or methylated C nucleotide
  modified_base (22)..(22): c or methylated C nucleotide
  modified_base (34)..(34): c or methylated C nucleotide
  modified_base (37)..(37): c or methylated C nucleotide
tctcttcgcgcaggcctgggtcgtccctcctagcgccgggaagc

SEQ ID NO: 249 - DNA, 34 bp, Artificial
  synthetic oligonucleotide
  modified_base (5)..(5): c or methylated C nucleotide
  modified_base (7)..(7): c or methylated C nucleotide
  modified_base (20)..(20): c or methylated C nucleotide
  modified_base (32)..(32): c or methylated C nucleotide
tcttcgcgcaggcctgggtcgtccctcctagcgc

SEQ ID NO: 250 - DNA, 34 bp, Artificial
  synthetic oligonucleotide
  modified_base (8)..(8): c or methylated C nucleotide
  modified_base (10)..(10): c or methylated C nucleotide
  modified_base (23)..(23): c or methylated C nucleotide
ctctcttcgcgcaggcctgggtcgtccctcctag

SEQ ID NO: 251 - DNA, 34 bp, Artificial
  synthetic oligonucleotide
  modified_base (11)..(11): c or methylated C nucleotide
  modified_base (13)..(13): c or methylated C nucleotide
  modified_base (26)..(26): c or methylated C nucleotide
tccctctcttcgcgcaggcctgggtcgtccctcc

SEQ ID NO: 252 - DNA, 34 bp, Artificial
  synthetic oligonucleotide
  modified_base (14)..(14): c or methylated C nucleotide
  modified_base (16)..(16): c or methylated C nucleotide
  modified_base (29)..(29): c or methylated C nucleotide
ttctccctctcttcgcgcaggcctgggtcgtccc

SEQ ID NO: 253 - DNA, 34 bp, Artificial
  synthetic oligonucleotide
  modified_base (17)..(17): c or methylated C nucleotide
  modified_base (19)..(19): c or methylated C nucleotide
  modified_base (32)..(32): c or methylated C nucleotide
actttctccctctcttcgcgcaggcctgggtcgt

SEQ ID NO: 254 - DNA, 34 bp, Artificial
  synthetic oligonucleotide
  modified_base (1)..(1): c or methylated C nucleotide
  modified_base (14)..(14): c or methylated C nucleotide
  modified_base (26)..(26): c or methylated C nucleotide
  modified_base (29)..(29): c or methylated C nucleotide
cgcaggcctgggtcgtccctcctagcgccgggaa

SEQ ID NO: 255 - DNA, 34 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
aggcctgggtcgtccctcctagcgccgggaagct

SEQ ID NO: 256 - DNA, 34 bp, Artificial
  synthetic oligonucleotide
  modified_base (8)..(8): c or methylated C nucleotide
  modified_base (20)..(20): c or methylated C nucleotide
  modified_base (23)..(23): c or methylated C nucleotide
cctgggtcgtccctcctagcgccgggaagctggg

SEQ ID NO: 257 - DNA, 34 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
gggtcgtccctcctagcgccgggaagctgggttg

SEQ ID NO: 258 - DNA, 34 bp, Artificial
  synthetic oligonucleotide
  modified_base (2)..(2): c or methylated C nucleotide
  modified_base (14)..(14): c or methylated C nucleotide
  modified_base (17)..(17): c or methylated C nucleotide
tcgtccctcctagcgccgggaagctgggttgcct

SEQ ID NO: 259 - DNA, 32 bp, Artificial
  synthetic oligonucleotide
  modified_base (2)..(2): c or methylated C nucleotide
  modified_base (15)..(15): c or methylated C nucleotide
  modified_base (27)..(27): c or methylated C nucleotide
  modified_base (30)..(30): c or methylated C nucleotide
gcgcaggcctgggtcgtccctcctagcgccgg

SEQ ID NO: 260 - DNA, 30 bp, Artificial
  synthetic oligonucleotide
  modified_base (13)..(13): c or methylated C nucleotide
  modified_base (25)..(25): c or methylated C nucleotide
  modified_base (28)..(28): c or methylated C nucleotide
gcaggcctgggtcgtccctcctagcgccgg

SEQ ID NO: 261 - DNA, 28 bp, Artificial
  synthetic oligonucleotide
  modified_base (11)..(11): c or methylated C nucleotide
  modified_base (23)..(23): c or methylated C nucleotide
  modified_base (26)..(26): c or methylated C nucleotide
aggcctgggtcgtccctcctagcgccgg

SEQ ID NO: 262 - DNA, 26 bp, Artificial
  synthetic oligonucleotide
  modified_base (9)..(9): c or methylated C nucleotide
  modified_base (21)..(21): c or methylated C nucleotide
  modified_base (24)..(24): c or methylated C nucleotide
gcctgggtcgtccctcctagcgccgg

SEQ ID NO: 263 - DNA, 24 bp, Artificial
  synthetic oligonucleotide
  modified_base (7)..(7): c or methylated C nucleotide
  modified_base (19)..(19): c or methylated C nucleotide
  modified_base (22)..(22): c or methylated C nucleotide
ctgggtcgtccctcctagcgccgg

SEQ ID NO: 264 - DNA, 22 bp, Artificial
  synthetic oligonucleotide
  modified_base (5)..(5): c or methylated C nucleotide
  modified_base (17)..(17): c or methylated C nucleotide
  modified_base (20)..(20): c or methylated C nucleotide
gggtcgtccctcctagcgccgg

SEQ ID NO: 265 - DNA, 20 bp, Artificial
  synthetic oligonucleotide
  modified_base (3)..(3): c or methylated C nucleotide
  modified_base (15)..(15): c or methylated C nucleotide
  modified_base (18)..(18): c or methylated C nucleotide
gtcgtccctcctagcgccgg

SEQ ID NO: 266 - DNA, 18 bp, Artificial
  synthetic oligonucleotide
  modified_base (1)..(1): c or methylated C nucleotide
  modified_base (13)..(13): c or methylated C nucleotide
  modified_base (16)..(16): c or methylated C nucleotide
cgtccctcctagcgccgg

SEQ ID NO: 267 - DNA, 16 bp, Artificial
  synthetic oligonucleotide
  modified_base (11)..(11): c or methylated C nucleotide
  modified_base (14)..(14): c or methylated C nucleotide
tccctcctagcgccgg

SEQ ID NO: 268 - DNA, 15 bp, Artificial
  synthetic oligonucleotide
  modified_base (10)..(10): c or methylated C nucleotide
  modified_base (13)..(13): c or methylated C nucleotide
ccctcctagcgccgg

SEQ ID NO: 269 - DNA, 32 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctcctagcgcc

SEQ ID NO: 270 - DNA, 30 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
tcgcgcaggcctgggtcgtccctcctagcg

SEQ ID NO: 271 - DNA, 28 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctcctag

SEQ ID NO: 272 - DNA, 26 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctcct

SEQ ID NO: 273 - DNA, 24 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccctc

SEQ ID NO: 274 - DNA, 22 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtccc

SEQ ID NO: 275 - DNA, 20 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcgtc

SEQ ID NO: 276 - DNA, 18 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
tcgcgcaggcctgggtcg

SEQ ID NO: 277 - DNA, 16 bp, Artificial
  synthetic oligonucleotide
  modified_base (2)..(2): c or methylated C nucleotide
  modified_base (4)..(4): c or methylated C nucleotide
tcgcgcaggcctgggt

SEQ ID NO: 278 - DNA, 15 bp, Artificial
  synthetic oligonucleotide
  modified_base (2)..(2): c or methylated C nucleotide
  modified_base (4)..(4): c or methylated C nucleotide
tcgcgcaggcctggg

SEQ ID NO: 279 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcacaggcctgggtcgtccctcctagcgccgg

SEQ ID NO: 280 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgttcctcctagcgccgg

SEQ ID NO: 281 - DNA, 34 bp, Artificial
  synthetic oligonucleotide
  modified_base (2)..(2): c or methylated C nucleotide
  modified_base (4)..(4): c or methylated C nucleotide
  modified_base (17)..(17): c or methylated C nucleotide
  modified_base (29)..(29): c or methylated C nucleotide
  modified_base (32)..(32): c or methylated C nucleotide
tcgcgcaggcctgggtcgtccctccgagcgccgg

SEQ ID NO: 282 - DNA, 719 bp, Homo sapiens
cctgagggtggcggggtgctcttcgcagcttctctgtggagaccggtcagcggggcggcgtggccgctcgcggcgtctccctggtggcatccgcacagcccgccgcggtccggtcccgctccgggtcagaattggcggctgcggggacagccttgcggctaggcagggggcgggccgccgcgtgggtccggcagtccctcctcccgccaaggcgccgcccagacccgctctccagccggcccggctcgccaccctagaccgccccagccaccccttcctccgccggcccggcccccgctcctcccccgccggcccggcccggccccctccttctccccgccggcgctcgctgcctccccctcttccctcttcccacaccgccctcagccgctccctctcgtacgcccgtctgaagaagaatcgagcgcggaacgcatcgatagctctgccctctgcggccgcccggccccgaactcatcggtgtgctcggagctcgattttcctaggcggcggccgcggcggcggaggcagcagcggcggcggcagtggcggcggcgaaggtggcggcggctcggccagtactcccggcccccgccatttcggactgggagcgagcgcggcgcaggcactgaaggcggcggcggggccagaggctcagcggctcccaggtgcgggagagaggtacggagcggaccacccctcctgggcccctgcccggg

SEQ ID NO: 283 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcgg

SEQ ID NO: 284 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcc

SEQ ID NO: 285 - DNA, 23 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (13)..(13): c or methylated C nucleotide
  modified_base (17)..(17): c or methylated C nucleotide
  modified_base (20)..(20): c or methylated C nucleotide
cctccgccgccgcggccgccgcc

SEQ ID NO: 286 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgct

SEQ ID NO: 287 - DNA, 27 bp, Artificial
  synthetic oligonucleotide
  modified_base (2)..(2): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
ccgagccgccgccaccttcgccgccgc

SEQ ID NO: 288 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (11)..(11): c or methylated C nucleotide
  modified_base (22)..(22): c or methylated C nucleotide
tgcgcgcgctcgctcccagtccgaa

SEQ ID NO: 289 - DNA, 28 bp, Artificial
  synthetic oligonucleotide
gcggccacgccgccccgctgaccggtct

SEQ ID NO: 290 - DNA, 29 bp, Artificial
  synthetic oligonucleotide
ccacagagaagctgcgaagagcaccccgc

SEQ ID NO: 291 - DNA, 34 bp, Artificial
  synthetic oligonucleotide
gcgggctgtgcggatgccacagggagacgccgcg

SEQ ID NO: 292 - DNA, 26 bp, Artificial
  synthetic oligonucleotide
gccgcaaggctgtccccgcagccgcc

SEQ ID NO: 293 - DNA, 25 bp, Artificial
  synthetic oligonucleotide
gcgggtctgggcggcgccttggcgg

SEQ ID NO: 294 - DNA, 27 bp, Artificial
  synthetic oligonucleotide
cggtctagggtggcgagccgggccggc

SEQ ID NO: 295 - DNA, 33 bp, Artificial
  synthetic oligonucleotide
gccggcgggggaggagcgggggccgggccggcg

SEQ ID NO: 296 - DNA, 37 bp, Artificial
  synthetic oligonucleotide
gcgagcgccggcggggagaaggagggggccgggccgg

SEQ ID NO: 297 - DNA, 23 bp, Artificial
  synthetic oligonucleotide
gctatcgatgcgttccgcgctcg

SEQ ID NO: 298 - DNA, 42 bp, Artificial
  synthetic oligonucleotide
cgagctccgagcacaccgatgagttcggggccgggcggccgc

SEQ ID NO: 299 - DNA, 33 bp, Artificial
  synthetic oligonucleotide
gacgggcgtacgagagggagcggctgagggcgg

SEQ ID NO: 300 - DNA, 31 bp, Artificial
  synthetic oligonucleotide
ccgctgagcctctggccccgccgccgccttc

SEQ ID NO: 301 - DNA, 21 bp, Artificial
  synthetic oligonucleotide
cgctccgtacctctctcccgc

SEQ ID NO: 302 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcgg

SEQ ID NO: 303 - DNA, 24 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (20)..(20): c or methylated C nucleotide
  modified_base (22)..(22): c or methylated C nucleotide
acccggagcgggaccggaccgcgg

SEQ ID NO: 304 - DNA, 25 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (21)..(21): c or methylated C nucleotide
  modified_base (23)..(23): c or methylated C nucleotide
gacccggagcgggaccggaccgcgg

SEQ ID NO: 305 - DNA, 26 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
  modified_base (24)..(24): c or methylated C nucleotide
tgacccggagcgggaccggaccgcgg

SEQ ID NO: 306 - DNA, 27 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (23)..(23): c or methylated C nucleotide
  modified_base (25)..(25): c or methylated C nucleotide
ctgacccggagcgggaccggaccgcgg

SEQ ID NO: 307 - DNA, 28 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (24)..(24): c or methylated C nucleotide
  modified_base (26)..(26): c or methylated C nucleotide
tctgacccggagcgggaccggaccgcgg

SEQ ID NO: 308 - DNA, 24 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggc

SEQ ID NO: 309 - DNA, 25 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcg

SEQ ID NO: 310 - DNA, 26 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcgg

SEQ ID NO: 311 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcggg

SEQ ID NO: 312 - DNA, 28 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgcggcgggc

SEQ ID NO: 313 - DNA, 25 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (20)..(20): c or methylated C nucleotide
  modified_base (22)..(22): c or methylated C nucleotide
acccggagcgggaccggaccgcggc

SEQ ID NO: 314 - DNA, 27 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (21)..(21): c or methylated C nucleotide
  modified_base (23)..(23): c or methylated C nucleotide
gacccggagcgggaccggaccgcggcg

SEQ ID NO: 315 - DNA, 29 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
  modified_base (24)..(24): c or methylated C nucleotide
tgacccggagcgggaccggaccgcggcgg

SEQ ID NO: 316 - DNA, 31 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (23)..(23): c or methylated C nucleotide
  modified_base (25)..(25): c or methylated C nucleotide
ctgacccggagcgggaccggaccgcggcggg

SEQ ID NO: 317 - DNA, 33 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (24)..(24): c or methylated C nucleotide
  modified_base (26)..(26): c or methylated C nucleotide
tctgacccggagcgggaccggaccgcggcgggc

SEQ ID NO: 318 - DNA, 23 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (22)..(22): c or methylated C nucleotide
tgacccggagcgggaccggaccg

SEQ ID NO: 319 - DNA, 23 bp, Artificial
  synthetic oligonucleotide
  modified_base (9)..(9): c or methylated C nucleotide
  modified_base (14)..(14): c or methylated C nucleotide
  modified_base (20)..(20): c or methylated C nucleotide
ttctgacccggagcgggaccgga

SEQ ID NO: 320 - DNA, 23 bp, Artificial
  synthetic oligonucleotide
  modified_base (12)..(12): c or methylated C nucleotide
  modified_base (17)..(17): c or methylated C nucleotide
  modified_base (23)..(23): c or methylated C nucleotide
caattctgacccggagcgggacc

SEQ ID NO: 321 - DNA, 23 bp, Artificial
  synthetic oligonucleotide
  modified_base (15)..(15): c or methylated C nucleotide
  modified_base (20)..(20): c or methylated C nucleotide
cgccaattctgacccggagcggg

SEQ ID NO: 322 - DNA, 23 bp, Artificial
  synthetic oligonucleotide
  modified_base (18)..(18): c or methylated C nucleotide
  modified_base (23)..(23): c or methylated C nucleotide
agccgccaattctgacccggagc

SEQ ID NO: 323 - DNA, 23 bp, Artificial
  synthetic oligonucleotide
  modified_base (5)..(5): c or methylated C nucleotide
  modified_base (11)..(11): c or methylated C nucleotide
  modified_base (16)..(16): c or methylated C nucleotide
  modified_base (18)..(18): c or methylated C nucleotide
ggagcgggaccggaccgcggcgg

SEQ ID NO: 324 - DNA, 23 bp, Artificial
  synthetic oligonucleotide
  modified_base (2)..(2): c or methylated C nucleotide
  modified_base (8)..(8): c or methylated C nucleotide
  modified_base (13)..(13): c or methylated C nucleotide
  modified_base (15)..(15): c or methylated C nucleotide
gcgggaccggaccgcggcgggct

SEQ ID NO: 325 - DNA, 23 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
ggaccggaccgcggcgggctgtg

SEQ ID NO: 326 - DNA, 23 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
ccggaccgcggcgggctgtgcgg

SEQ ID NO: 327 - DNA, 23 bp, Artificial
  synthetic oligonucleotide
  modified_base (4)..(4): c or methylated C nucleotide
  modified_base (6)..(6): c or methylated C nucleotide
gaccgcggcgggctgtgcggatg

SEQ ID NO: 328 - DNA, 21 bp, Artificial
  synthetic oligonucleotide
  modified_base (1)..(1): c or methylated C nucleotide
  modified_base (6)..(6): c or methylated C nucleotide
  modified_base (12)..(12): c or methylated C nucleotide
  modified_base (17)..(17): c or methylated C nucleotide
  modified_base (19)..(19): c or methylated C nucleotide
cggagcgggaccggaccgcgg

SEQ ID NO: 329 - DNA, 19 bp, Artificial
  synthetic oligonucleotide
  modified_base (4)..(4): c or methylated C nucleotide
  modified_base (10)..(10): c or methylated C nucleotide
  modified_base (15)..(15): c or methylated C nucleotide
  modified_base (17)..(17): c or methylated C nucleotide
gagcgggaccggaccgcgg

SEQ ID NO: 330 - DNA, 17 bp, Artificial
  synthetic oligonucleotide
  modified_base (2)..(2): c or methylated C nucleotide
  modified_base (8)..(8): c or methylated C nucleotide
  modified_base (13)..(13): c or methylated C nucleotide
  modified_base (15)..(15): c or methylated C nucleotide
gcgggaccggaccgcgg

SEQ ID NO: 331 - DNA, 15 bp, Artificial
  synthetic oligonucleotide
  modified_base (6)..(6): c or methylated C nucleotide
  modified_base (11)..(11): c or methylated C nucleotide
  modified_base (13)..(13): c or methylated C nucleotide
gggaccggaccgcgg

SEQ ID NO: 332 - DNA, 21 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccgc

SEQ ID NO: 333 - DNA, 19 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
cccggagcgggaccggacc

SEQ ID NO: 334 - DNA, 17 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
cccggagcgggaccgga

SEQ ID NO: 335 - DNA, 15 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
cccggagcgggaccg

SEQ ID NO: 336 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagccggaccggaccgcgg

SEQ ID NO: 337 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
cccggagcgggaccggaccacgg

SEQ ID NO: 338 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (19)..(19): c or methylated C nucleotide
  modified_base (21)..(21): c or methylated C nucleotide
ccctgagcgggaccggaccgcgg

SEQ ID NO: 339 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcc

SEQ ID NO: 340 - DNA, 25 bp, Artificial
  synthetic oligonucleotide
  modified_base (4)..(4): c or methylated C nucleotide
  modified_base (12)..(12): c or methylated C nucleotide
  modified_base (14)..(14): c or methylated C nucleotide
  modified_base (17)..(17): c or methylated C nucleotide
  modified_base (22)..(22): c or methylated C nucleotide
tgccggacccacgcggcggcccgcc

SEQ ID NO: 341 - DNA, 26 bp, Artificial
  synthetic oligonucleotide
  modified_base (5)..(5): c or methylated C nucleotide
  modified_base (13)..(13): c or methylated C nucleotide
  modified_base (15)..(15): c or methylated C nucleotide
  modified_base (18)..(18): c or methylated C nucleotide
  modified_base (23)..(23): c or methylated C nucleotide
ctgccggacccacgcggcggcccgcc

SEQ ID NO: 342 - DNA, 27 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggcccgcc

SEQ ID NO: 343 - DNA, 28 bp, Artificial
  synthetic oligonucleotide
  modified_base (7)..(7): c or methylated C nucleotide
  modified_base (15)..(15): c or methylated C nucleotide
  modified_base (17)..(17): c or methylated C nucleotide
  modified_base (20)..(20): c or methylated C nucleotide
  modified_base (25)..(25): c or methylated C nucleotide
gactgccggacccacgcggcggcccgcc

SEQ ID NO: 344 - DNA, 29 bp, Artificial
  synthetic oligonucleotide
  modified_base (8)..(8): c or methylated C nucleotide
  modified_base (16)..(16): c or methylated C nucleotide
  modified_base (18)..(18): c or methylated C nucleotide
  modified_base (21)..(21): c or methylated C nucleotide
  modified_base (26)..(26): c or methylated C nucleotide
ggactgccggacccacgcggcggcccgcc

SEQ ID NO: 345 - DNA, 25 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccc

SEQ ID NO: 346 - DNA, 26 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgcccc

SEQ ID NO: 347 - DNA, 27 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccc

SEQ ID NO: 348 - DNA, 28 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccct

SEQ ID NO: 349 - DNA, 29 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccgccccctg

SEQ ID NO: 350 - DNA, 26 bp, Artificial
  synthetic oligonucleotide
  modified_base (4)..(4): c or methylated C nucleotide
  modified_base (12)..(12): c or methylated C nucleotide
  modified_base (14)..(14): c or methylated C nucleotide
  modified_base (17)..(17): c or methylated C nucleotide
  modified_base (22)..(22): c or methylated C nucleotide
tgccggacccacgcggcggcccgccc

SEQ ID NO: 351 - DNA, 28 bp, Artificial
  synthetic oligonucleotide
  modified_base (5)..(5): c or methylated C nucleotide
  modified_base (13)..(13): c or methylated C nucleotide
  modified_base (15)..(15): c or methylated C nucleotide
  modified_base (18)..(18): c or methylated C nucleotide
  modified_base (23)..(23): c or methylated C nucleotide
ctgccggacccacgcggcggcccgcccc

SEQ ID NO: 352 - DNA, 30 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggcccgccccc

SEQ ID NO: 353 - DNA, 32 bp, Artificial
  synthetic oligonucleotide
  modified_base (7)..(7): c or methylated C nucleotide
  modified_base (15)..(15): c or methylated C nucleotide
  modified_base (17)..(17): c or methylated C nucleotide
  modified_base (20)..(20): c or methylated C nucleotide
  modified_base (25)..(25): c or methylated C nucleotide
gactgccggacccacgcggcggcccgccccct

SEQ ID NO: 354 - DNA, 34 bp, Artificial
  synthetic oligonucleotide
  modified_base (8)..(8): c or methylated C nucleotide
  modified_base (16)..(16): c or methylated C nucleotide
  modified_base (18)..(18): c or methylated C nucleotide
  modified_base (21)..(21): c or methylated C nucleotide
  modified_base (26)..(26): c or methylated C nucleotide
ggactgccggacccacgcggcggcccgccccctg

SEQ ID NO: 355 - DNA, 24 bp, Artificial
  synthetic oligonucleotide
  modified_base (6)..(6): c or methylated C nucleotide
  modified_base (14)..(14): c or methylated C nucleotide
  modified_base (16)..(16): c or methylated C nucleotide
  modified_base (19)..(19): c or methylated C nucleotide
  modified_base (24)..(24): c or methylated C nucleotide
actgccggacccacgcggcggccc

SEQ ID NO: 356 - DNA, 24 bp, Artificial
  synthetic oligonucleotide
  modified_base (9)..(9): c or methylated C nucleotide
  modified_base (17)..(17): c or methylated C nucleotide
  modified_base (19)..(19): c or methylated C nucleotide
  modified_base (22)..(22): c or methylated C nucleotide
gggactgccggacccacgcggcgg

SEQ ID NO: 357 - DNA, 24 bp, Artificial
  synthetic oligonucleotide
  modified_base (12)..(12): c or methylated C nucleotide
  modified_base (20)..(20): c or methylated C nucleotide
  modified_base (22)..(22): c or methylated C nucleotide
ggagggactgccggacccacgcgg

SEQ ID NO: 358 - DNA, 24 bp, Artificial
  synthetic oligonucleotide
  modified_base (15)..(15): c or methylated C nucleotide
  modified_base (23)..(23): c or methylated C nucleotide
ggaggagggactgccggacccacg

SEQ ID NO: 359 - DNA, 24 bp, Artificial
  synthetic oligonucleotide
  modified_base (18)..(18): c or methylated C nucleotide
gcgggaggagggactgccggaccc

SEQ ID NO: 360 - DNA, 24 bp, Artificial
  synthetic oligonucleotide
  modified_base (8)..(8): c or methylated C nucleotide
  modified_base (10)..(10): c or methylated C nucleotide
  modified_base (13)..(13): c or methylated C nucleotide
  modified_base (18)..(18): c or methylated C nucleotide
ggacccacgcggcggcccgccccc

SEQ ID NO: 361 - DNA, 24 bp, Artificial
  synthetic oligonucleotide
  modified_base (5)..(5): c or methylated C nucleotide
  modified_base (7)..(7): c or methylated C nucleotide
  modified_base (10)..(10): c or methylated C nucleotide
  modified_base (15)..(15): c or methylated C nucleotide
cccacgcggcggcccgccccctgc

SEQ ID NO: 362 - DNA, 24 bp, Artificial
  synthetic oligonucleotide
  modified_base (2)..(2): c or methylated C nucleotide
  modified_base (4)..(4): c or methylated C nucleotide
  modified_base (7)..(7): c or methylated C nucleotide
  modified_base (12)..(12): c or methylated C nucleotide
acgcggcggcccgccccctgccta

SEQ ID NO: 363 - DNA, 24 bp, Artificial
  synthetic oligonucleotide
  modified_base (1)..(1): c or methylated C nucleotide
  modified_base (4)..(4): c or methylated C nucleotide
  modified_base (9)..(9): c or methylated C nucleotide
cggcggcccgccccctgcctagcc

SEQ ID NO: 364 - DNA, 24 bp, Artificial
  synthetic oligonucleotide
  modified_base (1)..(1): c or methylated C nucleotide
  modified_base (6)..(6): c or methylated C nucleotide
cggcccgccccctgcctagccgca

SEQ ID NO: 365 - DNA, 22 bp, Artificial
  synthetic oligonucleotide
  modified_base (1)..(1): c or methylated C nucleotide
  modified_base (9)..(9): c or methylated C nucleotide
  modified_base (11)..(11): c or methylated C nucleotide
  modified_base (14)..(14): c or methylated C nucleotide
  modified_base (19)..(19): c or methylated C nucleotide
cggacccacgcggcggcccgcc

SEQ ID NO: 366 - DNA, 20 bp, Artificial
  synthetic oligonucleotide
  modified_base (7)..(7): c or methylated C nucleotide
  modified_base (9)..(9): c or methylated C nucleotide
  modified_base (12)..(12): c or methylated C nucleotide
  modified_base (17)..(17): c or methylated C nucleotide
gacccacgcggcggcccgcc

SEQ ID NO: 367 - DNA, 18 bp, Artificial
  synthetic oligonucleotide
  modified_base (5)..(5): c or methylated C nucleotide
  modified_base (7)..(7): c or methylated C nucleotide
  modified_base (10)..(10): c or methylated C nucleotide
  modified_base (15)..(15): c or methylated C nucleotide
cccacgcggcggcccgcc

SEQ ID NO: 368 - DNA, 16 bp, Artificial
  synthetic oligonucleotide
  modified_base (3)..(3): c or methylated C nucleotide
  modified_base (5)..(5): c or methylated C nucleotide
  modified_base (8)..(8): c or methylated C nucleotide
  modified_base (13)..(13): c or methylated C nucleotide
cacgcggcggcccgcc

SEQ ID NO: 369 - DNA, 15 bp, Artificial
  synthetic oligonucleotide
  modified_base (2)..(2): c or methylated C nucleotide
  modified_base (4)..(4): c or methylated C nucleotide
  modified_base (7)..(7): c or methylated C nucleotide
  modified_base (12)..(12): c or methylated C nucleotide
acgcggcggcccgcc

SEQ ID NO: 370 - DNA, 22 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgcggcggcccg

SEQ ID NO: 371 - DNA, 20 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggcggcc

SEQ ID NO: 372 - DNA, 18 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggcgg

SEQ ID NO: 373 - DNA, 16 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
gccggacccacgcggc

SEQ ID NO: 374 - DNA, 15 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
gccggacccacgcgg

SEQ ID NO: 375 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccgggcccacgcggcggcccgcc

SEQ ID NO: 376 - DNA, 24 bp, Artificial
  synthetic oligonucleotide
  modified_base (3)..(3): c or methylated C nucleotide
  modified_base (11)..(11): c or methylated C nucleotide
  modified_base (13)..(13): c or methylated C nucleotide
  modified_base (16)..(16): c or methylated C nucleotide
  modified_base (21)..(21): c or methylated C nucleotide
gccggacccacgctgcggcccgcc

SEQ ID NO: 377 - DNA, 24 bp, Artificial
  synthetic oligonucleotide
  modified_base (3)..(3): synthetic oligonucleotide
  modified_base (11)..(11): synthetic oligonucleotide
  modified_base (13)..(13): synthetic oligonucleotide
  modified_base (16)..(16): synthetic oligonucleotide
  modified_base (21)..(21): synthetic oligonucleotide
gccggacccacgcggcggtccgcc

SEQ ID NO: 378 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgct

SEQ ID NO: 379 - DNA, 28 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
cttcgccgccgccactgccgccgccgct

SEQ ID NO: 380 - DNA, 29 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (26)..(26): c or methylated C nucleotide
ccttcgccgccgccactgccgccgccgct

SEQ ID NO: 381 - DNA, 30 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgccgct

SEQ ID NO: 382 - DNA, 31 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (28)..(28): c or methylated C nucleotide
caccttcgccgccgccactgccgccgccgct

SEQ ID NO: 383 - DNA, 32 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (29)..(29): c or methylated C nucleotide
ccaccttcgccgccgccactgccgccgccgct

SEQ ID NO: 384 - DNA, 28 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctg

SEQ ID NO: 385 - DNA, 29 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgc

SEQ ID NO: 386 - DNA, 30 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgct

SEQ ID NO: 387 - DNA, 31 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgctg

SEQ ID NO: 388 - DNA, 32 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccgctgctgc

SEQ ID NO: 389 - DNA, 29 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (25)..(25): c or methylated C nucleotide
cttcgccgccgccactgccgccgccgctg

SEQ ID NO: 390 - DNA, 31 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (26)..(26): c or methylated C nucleotide
ccttcgccgccgccactgccgccgccgctgc

SEQ ID NO: 391 - DNA, 33 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgccgctgct

SEQ ID NO: 392 - DNA, 35 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (28)..(28): c or methylated C nucleotide
caccttcgccgccgccactgccgccgccgctgctg

SEQ ID NO: 393 - DNA, 37 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (29)..(29): c or methylated C nucleotide
ccaccttcgccgccgccactgccgccgccgctgctgc

SEQ ID NO: 394 - DNA, 27 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (27)..(27): c or methylated C nucleotide
accttcgccgccgccactgccgccgcc

SEQ ID NO: 395 - DNA, 27 bp, Artificial
  synthetic oligonucleotide
  modified_base (9)..(9): c or methylated C nucleotide
  modified_base (12)..(12): c or methylated C nucleotide
  modified_base (15)..(15): c or methylated C nucleotide
  modified_base (24)..(24): c or methylated C nucleotide
  modified_base (27)..(27): c or methylated C nucleotide
gccaccttcgccgccgccactgccgcc

SEQ ID NO: 396 - DNA, 27 bp, Artificial
  synthetic oligonucleotide
  modified_base (12)..(12): c or methylated C nucleotide
  modified_base (15)..(15): c or methylated C nucleotide
  modified_base (18)..(18): c or methylated C nucleotide
  modified_base (27)..(27): c or methylated C nucleotide
gccgccaccttcgccgccgccactgcc

SEQ ID NO: 397 - DNA, 27 bp, Artificial
  synthetic oligonucleotide
  modified_base (15)..(15): c or methylated C nucleotide
  modified_base (18)..(18): c or methylated C nucleotide
  modified_base (21)..(21): c or methylated C nucleotide
gccgccgccaccttcgccgccgccact

SEQ ID NO: 398 - DNA, 27 bp, Artificial
  synthetic oligonucleotide
  modified_base (18)..(18): c or methylated C nucleotide
  modified_base (21)..(21): c or methylated C nucleotide
  modified_base (24)..(24): c or methylated C nucleotide
cgagccgccgccaccttcgccgccgcc

SEQ ID NO: 399 - DNA, 27 bp, Artificial
  synthetic oligonucleotide
  modified_base (3)..(3): c or methylated C nucleotide
  modified_base (6)..(6): c or methylated C nucleotide
  modified_base (15)..(15): c or methylated C nucleotide
  modified_base (18)..(18): c or methylated C nucleotide
  modified_base (21)..(21): c or methylated C nucleotide
gccgccgccactgccgccgccgctgct

SEQ ID NO: 400 - DNA, 27 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (18)..(18): c or methylated C nucleotide
gccgccactgccgccgccgctgctgcc

SEQ ID NO: 401 - DNA, 27 bp, Artificial
  synthetic oligonucleotide
  modified_base (9)..(9): c or methylated C nucleotide
  modified_base (12)..(12): c or methylated C nucleotide
  modified_base (15)..(15): c or methylated C nucleotide
gccactgccgccgccgctgctgcctcc

SEQ ID NO: 402 - DNA, 27 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
actgccgccgccgctgctgcctccgcc

SEQ ID NO: 403 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
gccgccgccgctgctgcctccgccgcc

SEQ ID NO: 404 - DNA, 25 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (16)..(16): c or methylated C nucleotide
  modified_base (19)..(19): c or methylated C nucleotide
  modified_base (22)..(22): c or methylated C nucleotide
cgccgccgccactgccgccgccgct

SEQ ID NO: 405 - DNA, 23 bp, Artificial
  synthetic oligonucleotide
  modified_base (2)..(2): c or methylated C nucleotide
  modified_base (5)..(5): c or methylated C nucleotide
  modified_base (14)..(14): c or methylated C nucleotide
  modified_base (17)..(17): c or methylated C nucleotide
  modified_base (20)..(20): c or methylated C nucleotide
ccgccgccactgccgccgccgct

SEQ ID NO: 406 - DNA, 21 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (18)..(18): c or methylated C nucleotide
gccgccactgccgccgccgct

SEQ ID NO: 407 - DNA, 19 bp, Artificial
  synthetic oligonucleotide
  modified_base (1)..(1): c or methylated C nucleotide
  modified_base (10)..(10): c or methylated C nucleotide
  modified_base (13)..(13): c or methylated C nucleotide
  modified_base (16)..(16): c or methylated C nucleotide
cgccactgccgccgccgct

SEQ ID NO: 408 - DNA, 17 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
ccactgccgccgccgct

SEQ ID NO: 409 - DNA, 15 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
actgccgccgccgct

SEQ ID NO: 410 - DNA, 25 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactgccgccgccg

SEQ ID NO: 411 - DNA, 23 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ttcgccgccgccactgccgccgc

SEQ ID NO: 412 - DNA, 21 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ttcgccgccgccactgccgcc

SEQ ID NO: 413 - DNA, 19 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
ttcgccgccgccactgccg

SEQ ID NO: 414 - DNA, 17 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
ttcgccgccgccactgc

SEQ ID NO: 415 - DNA, 15 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
ttcgccgccgccact

SEQ ID NO: 416 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcaccgccgccactgccgccgccgct

SEQ ID NO: 417 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgccactcccgccgccgct

SEQ ID NO: 418 - DNA, 27 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (24)..(24): c or methylated C nucleotide
ttcgccgccgtcactgccgccgccgct

SEQ ID NO: 419 - DNA, 28 bp, Artificial
  synthetic oligonucleotide
gcggccacgccgccccgctgaccggtct

SEQ ID NO: 420 - DNA, 29 bp, Artificial
  synthetic oligonucleotide
agcggccacgccgccccgctgaccggtct

SEQ ID NO: 421 - DNA, 30 bp, Artificial
  synthetic oligonucleotide
gagcggccacgccgccccgctgaccggtct

SEQ ID NO: 422 - DNA, 31 bp, Artificial
  synthetic oligonucleotide
cgagcggccacgccgccccgctgaccggtct

SEQ ID NO: 423 - DNA, 32 bp, Artificial
  synthetic oligonucleotide
gcgagcggccacgccgccccgctgaccggtct

SEQ ID NO: 424 - DNA, 33 bp, Artificial
  synthetic oligonucleotide
cgcgagcggccacgccgccccgctgaccggtct

SEQ ID NO: 425 - DNA, 29 bp, Artificial
  synthetic oligonucleotide
gcggccacgccgccccgctgaccggtctc

SEQ ID NO: 426 - DNA, 30 bp, Artificial
  synthetic oligonucleotide
gcggccacgccgccccgctgaccggtctcc

SEQ ID NO: 427 - DNA, 31 bp, Artificial
  synthetic oligonucleotide
gcggccacgccgccccgctgaccggtctcca

SEQ ID NO: 428 - DNA, 32 bp, Artificial
  synthetic oligonucleotide
gcggccacgccgccccgctgaccggtctccac

SEQ ID NO: 429 - DNA, 33 bp, Artificial
  synthetic oligonucleotide
gcggccacgccgccccgctgaccggtctccaca

SEQ ID NO: 430 - DNA, 30 bp, Artificial
  synthetic oligonucleotide
agcggccacgccgccccgctgaccggtctc

SEQ ID NO: 431 - DNA, 32 bp, Artificial
  synthetic oligonucleotide
gagcggccacgccgccccgctgaccggtctcc

SEQ ID NO: 432 - DNA, 34 bp, Artificial
  synthetic oligonucleotide
cgagcggccacgccgccccgctgaccggtctcca

SEQ ID NO: 433 - DNA, 36 bp, Artificial
  synthetic oligonucleotide
gcgagcggccacgccgccccgctgaccggtctccac

SEQ ID NO: 434 - DNA, 38 bp, Artificial
  synthetic oligonucleotide
cgcgagcggccacgccgccccgctgaccggtctccaca

SEQ ID NO: 435 - DNA, 28 bp, Artificial
  synthetic oligonucleotide
cgagcggccacgccgccccgctgaccgg

SEQ ID NO: 436 - DNA, 28 bp, Artificial
  synthetic oligonucleotide
ccgcgagcggccacgccgccccgctgac

SEQ ID NO: 437 - DNA, 28 bp, Artificial
  synthetic oligonucleotide
acgccgcgagcggccacgccgccccgct

SEQ ID NO: 438 - DNA, 28 bp, Artificial
  synthetic oligonucleotide
gagacgccgcgagcggccacgccgcccc

SEQ ID NO: 439 - DNA, 28 bp, Artificial
  synthetic oligonucleotide
agggagacgccgcgagcggccacgccgc

SEQ ID NO: 440 - DNA, 28 bp, Artificial
  synthetic oligonucleotide
gccacgccgccccgctgaccggtctcca

SEQ ID NO: 441 - DNA, 28 bp, Artificial
  synthetic oligonucleotide
acgccgccccgctgaccggtctccacag

SEQ ID NO: 442 - DNA, 28 bp, Artificial
  synthetic oligonucleotide
ccgccccgctgaccggtctccacagaga

SEQ ID NO: 443 - DNA, 28 bp, Artificial
  synthetic oligonucleotide
ccccgctgaccggtctccacagagaagc

SEQ ID NO: 444 - DNA, 28 bp, Artificial
  synthetic oligonucleotide
cgctgaccggtctccacagagaagctgc

SEQ ID NO: 445 - DNA, 26 bp, Artificial
  synthetic oligonucleotide
ggccacgccgccccgctgaccggtct

SEQ ID NO: 446 - DNA, 24 bp, Artificial
  synthetic oligonucleotide
ccacgccgccccgctgaccggtct

SEQ ID NO: 447 - DNA, 22 bp, Artificial
  synthetic oligonucleotide
acgccgccccgctgaccggtct

SEQ ID NO: 448 - DNA, 20 bp, Artificial
  synthetic oligonucleotide
gccgccccgctgaccggtct

SEQ ID NO: 449 - DNA, 18 bp, Artificial
  synthetic oligonucleotide
cgccccgctgaccggtct

SEQ ID NO: 450 - DNA, 16 bp, Artificial
  synthetic oligonucleotide
ccccgctgaccggtct

SEQ ID NO: 451 - DNA, 15 bp, Artificial
  synthetic oligonucleotide
cccgctgaccggtct

SEQ ID NO: 452 - DNA, 26 bp, Artificial
  synthetic oligonucleotide
gcggccacgccgccccgctgaccggt

SEQ ID NO: 453 - DNA, 24 bp, Artificial
  synthetic oligonucleotide
gcggccacgccgccccgctgaccg

SEQ ID NO: 454 - DNA, 22 bp, Artificial
  synthetic oligonucleotide
gcggccacgccgccccgctgac

SEQ ID NO: 455 - DNA, 20 bp, Artificial
  synthetic oligonucleotide
gcggccacgccgccccgctg

SEQ ID NO: 456 - DNA, 18 bp, Artificial
  synthetic oligonucleotide
gcggccacgccgccccgc

SEQ ID NO: 457 - DNA, 16 bp, Artificial
  synthetic oligonucleotide
gcggccacgccgcccc

SEQ ID NO: 458 - DNA, 15 bp, Artificial
  synthetic oligonucleotide
gcggccacgccgccc

SEQ ID NO: 459 - DNA, 28 bp, Artificial
  synthetic oligonucleotide
gcggccacgacgccccgctgaccggtct

SEQ ID NO: 460 - DNA, 28 bp, Artificial
  synthetic oligonucleotide
gcggccacgccgctccgctgaccggtct

SEQ ID NO: 461 - DNA, 28 bp, Artificial
  synthetic oligonucleotide
gcggccacgccgccccgcggaccggtct

SEQ ID NO: 462 - DNA, 1746 bp, Homo sapiens
ggatcccagcctttccccagcccgtagccccgggacctccgcggtgggcggcgccgcgctgccggcgcagggagggcctctggtgcaccggcaccgctgagtcgggttctctcgccggcctgttcccgggagagcccggggccctgctcggagatgccgccccgggcccccagacaccggctccctggccttcctcgagcaaccccgagctcggctccggtctccagccaagcccaaccccgagaggccgcggccctactggctccgcctcccgcgttgctcccggaagccccgcccgaccgcggctcctgacagacgggccgctcagccaaccggggtggggcggggcccgatggcgcgcagccaatggtaggccgcgcctggcagacggacgggcgcggggcggggcgtgcgcaggcccgcccgagtctccgccgcccgtgccctgcgcccgcaacccgagccgcacccgccgcggacggagcccatgcgcggggcgaaccgcgcgcccccgcccccgccccgccccggcctcggccccggccctggccccgggggcagtcgcgcctgtgaacggtgagtgcgggcagggatcggccgggccgcgcgccctcctcgcccccaggcggcagcaatacgcgcggcgcgggccgggggcgcggggccggcgggcgtaagcggcggcggcggcggcggcggcgggtgggtggggccgggcggggcccgcgggcacaggtgagcgggcgtcgggggctgcggcgggcgggggccccttcctccctggggcctgcgggaatccgggccccacccgtggcctcgcgctgggcacggtccccacgccggcgtacccgggagcctcgggcccggcgccctcacacccgggggcgtctgggaggaggcggccgcggccacggcacgcccgggcacccccgattcagcatcacaggtcgcggaccaggccgggggcctcagccccagtgccttttccctctccgggtctcccgcgccgcttctcggccccttcctgtcgctcagtccctgcttcccaggagctcctctgtcttctccagctttctgtggctgaaagatgcccccggttccccgccgggggtgcggggcgctgcccgggtctgccctcccctcggcggcgcctagtacgcagtaggcgctcagcaaatacttgtcggaggcaccagcgccgcggggcctgcaggctggcactagcctgcccgggcacgccgtggcgcgctccgccgtggccagacctgttctggaggacggtaacctcagccctcgggcgcctccctttagcctttctgccgacccagcagcttctaatttgggtgcgtggttgagagcgctcagctgtcagccctgcctttgagggctgggtcccttttcccatcactgggtcattaagagcaagtgggggcgaggcgacagccctcccgcacgctgggttgcagctgcacaggtaggcacgctgcagtccttgctgcctggcgttggggcccagggaccgctgtgggtttgcccttcagatggccctgccagcagctgccctgtggggcctggggctgggcctgggcctggctgagcagggccctccttggcaggtggggcaggagaccctgtaggaggaccccgggccgcaggcccctgaggagcgatgacggaatataagctggtggtggtgggcgccggcggtgtgggcaagagtgcgctgaccatccagctgatccagaa

SEQ ID NO: 463 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgg

SEQ ID NO: 464 - DNA, 26 bp, Artificial
  synthetic oligonucleotide
ggcgcgcggttcgccccgcgcatggg

SEQ ID NO: 465 - DNA, 32 bp, Artificial
  synthetic oligonucleotide
  modified_base (4)..(4): c or methylated C nucleotide
  modified_base (10)..(10): c or methylated C nucleotide
  modified_base (27)..(27): c or methylated C nucleotide
ttccgtcatcgctcctcaggggcctgcggccc

SEQ ID NO: 466 - DNA, 28 bp, Artificial
  synthetic oligonucleotide
  modified_base (2)..(2): c or methylated C nucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (22)..(22): c or methylated C nucleotide
  modified_base (26)..(26): c or methylated C nucleotide
gcgcacgccccgccccgcgcccgtccgt

SEQ ID NO: 467 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggt

SEQ ID NO: 468 - DNA, 30 bp, Artificial
  synthetic oligonucleotide
  modified_base (7)..(7): c or methylated C nucleotide
  modified_base (11)..(11): c or methylated C nucleotide
  modified_base (27)..(27): c or methylated C nucleotide
gggaggcgcccgagggctgaggttaccgtc

SEQ ID NO: 469 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctcc

SEQ ID NO: 470 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 471 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 472 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccgg

SEQ ID NO: 473 - DNA, 28 bp, Artificial
  synthetic oligonucleotide
  modified_base (2)..(2): c or methylated C nucleotide
  modified_base (5)..(5): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (20)..(20): c or methylated C nucleotide
  modified_base (26)..(26): c or methylated C nucleotide
acggcggagcgcgccacggcgtgcccgg

SEQ ID NO: 474 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgccccca

SEQ ID NO: 475 - DNA, 32 bp, Artificial
  synthetic oligonucleotide
  modified_base (2)..(2): c or methylated C nucleotide
  modified_base (8)..(8): c or methylated C nucleotide
  modified_base (25)..(25): c or methylated C nucleotide
  modified_base (30)..(30): c or methylated C nucleotide
ccgtcatcgctcctcaggggcctgcggcccgg

SEQ ID NO: 476 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgct

SEQ ID NO: 477 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 478 - DNA, 55 bp, Artificial
  synthetic oligonucleotide
  modified_base (4)..(4): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (26)..(26): c or methylated C nucleotide
  modified_base (32)..(32): c or methylated C nucleotide
  modified_base (34)..(34): c or methylated C nucleotide
  modified_base (36)..(36): c or methylated C nucleotide
  modified_base (41)..(41): c or methylated C nucleotide
  modified_base (46)..(46): c or methylated C nucleotide
  modified_base (48)..(48): c or methylated C nucleotide
ggccgaggccggggcggggcgggggcgggggcgcgcggttcgccccgcgcatggg

SEQ ID NO: 479 - DNA, 33 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
  modified_base (20)..(20): c or methylated C nucleotide
  modified_base (24)..(24): c or methylated C nucleotide
  modified_base (26)..(26): c or methylated C nucleotide
  modified_base (29)..(29): c or methylated C nucleotide
tcgccccgcgcatgggctccgtccgcggcgggt

SEQ ID NO: 480 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggca

SEQ ID NO: 481 - DNA, 38 bp, Artificial
  synthetic oligonucleotide
gcgccggcagcgcggcgccgcccaccgcggaggtcccg

SEQ ID NO: 482 - DNA, 33 bp, Artificial
  synthetic oligonucleotide
cggcgagagaacccgactcagcggtgccggtgc

SEQ ID NO: 483 - DNA, 34 bp, Artificial
  synthetic oligonucleotide
gcggcatctccgagcagggccccgggctctcccg

SEQ ID NO: 484 - DNA, 25 bp, Artificial
  synthetic oligonucleotide
ccggagccgagctcggggttgctcg

SEQ ID NO: 485 - DNA, 28 bp, Artificial
  synthetic oligonucleotide
gcggagccagtagggccgcggcctctcg

SEQ ID NO: 486 - DNA, 22 bp, Artificial
  synthetic oligonucleotide
cggggcttccgggagcaacgcg

SEQ ID NO: 487 - DNA, 27 bp, Artificial
  synthetic oligonucleotide
cggcccgtctgtcaggagccgcggtcg

SEQ ID NO: 488 - DNA, 24 bp, Artificial
  synthetic oligonucleotide
cgggcggcggagactcgggcgggc

SEQ ID NO: 489 - DNA, 37 bp, Artificial
  synthetic oligonucleotide
ccgttcacaggcgcgactgcccccgggccagggccgg

SEQ ID NO: 490 - DNA, 24 bp, Artificial
  synthetic oligonucleotide
cgaggagggcgcgcggcccggccg

SEQ ID NO: 491 - DNA, 34 bp, Artificial
  synthetic oligonucleotide
cgcgaggccacgggtggggcccggattcccgcag

SEQ ID NO: 492 - DNA, 26 bp, Artificial
  synthetic oligonucleotide
cgggtacgccggcgtggggaccgtgc

SEQ ID NO: 493 - DNA, 31 bp, Artificial
  synthetic oligonucleotide
cgcccccgggtgtgagggcgccgggcccgag

SEQ ID NO: 494 - DNA, 25 bp, Artificial
  synthetic oligonucleotide
cgggcgtgccgtggccgcggccgcc

SEQ ID NO: 495 - DNA, 30 bp, Artificial
  synthetic oligonucleotide
cgagaagcggcgcgggagacccggagaggg

SEQ ID NO: 496 - DNA, 28 bp, Artificial
  synthetic oligonucleotide
gcgccccgcacccccggcggggaaccgg

SEQ ID NO: 497 - DNA, 35 bp, Artificial
  synthetic oligonucleotide
gcgtactaggcgccgccgaggggagggcagacccg

SEQ ID NO: 498 - DNA, 38 bp, Artificial
  synthetic oligonucleotide
cgcggcgctggtgcctccgacaagtatttgctgagcgc

SEQ ID NO: 499 - DNA, 25 bp, Artificial
  synthetic oligonucleotide
gggagccggtgtctgggggcccggg

SEQ ID NO: 500 - DNA, 25 bp, Artificial
  synthetic oligonucleotide
ctgccaggcgcggcctaccattggc

SEQ ID NO: 501 - DNA, 24 bp, Artificial
  synthetic oligonucleotide
ctgtgcccgcgggccccgcccggc

SEQ ID NO: 502 - DNA, 39 bp, Artificial
  synthetic oligonucleotide
cggcctggtccgcgacctgtgatgctgaatcgggggtgc

SEQ ID NO: 503 - DNA, 29 bp, Artificial
  synthetic oligonucleotide
cagcgcactcttgccacaccgccggcgcc

SEQ ID NO: 504 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatggg

SEQ ID NO: 505 - DNA, 27 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatggg

SEQ ID NO: 506 - DNA, 28 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatggg

SEQ ID NO: 507 - DNA, 29 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcatggg

SEQ ID NO: 508 - DNA, 30 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatggg

SEQ ID NO: 509 - DNA, 31 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatggg

SEQ ID NO: 510 - DNA, 27 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggc

SEQ ID NO: 511 - DNA, 28 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggct

SEQ ID NO: 512 - DNA, 29 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctc

SEQ ID NO: 513 - DNA, 30 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctcc

SEQ ID NO: 514 - DNA, 31 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgggctccg

SEQ ID NO: 515 - DNA, 28 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatgggc

SEQ ID NO: 516 - DNA, 30 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatgggct

SEQ ID NO: 517 - DNA, 32 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcatgggctc

SEQ ID NO: 518 - DNA, 34 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatgggctcc

SEQ ID NO: 519 - DNA, 36 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatgggctccg

SEQ ID NO: 520 - DNA, 26 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcat

SEQ ID NO: 521 - DNA, 26 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
ggcgggggcgcgcggttcgccccgcg

SEQ ID NO: 522 - DNA, 26 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (26)..(26): c or methylated C nucleotide
gggggcgggggcgcgcggttcgcccc

SEQ ID NO: 523 - DNA, 26 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
ggcgggggcgggggcgcgcggttcgc

SEQ ID NO: 524 - DNA, 26 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
cggggcgggggcgggggcgcgcggtt

SEQ ID NO: 525 - DNA, 26 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
gcgcggttcgccccgcgcatgggctc

SEQ ID NO: 526 - DNA, 26 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatgggctccgt

SEQ ID NO: 527 - DNA, 26 bp, Artificial
  synthetic oligonucleotide
  modified_base (3)..(3): c or methylated C nucleotide
  modified_base (8)..(8): c or methylated C nucleotide
  modified_base (10)..(10): c or methylated C nucleotide
ttcgccccgcgcatgggctccgtccg

SEQ ID NO: 528 - DNA, 26 bp, Artificial
  synthetic oligonucleotide
  modified_base (5)..(5): c or methylated C nucleotide
  modified_base (7)..(7): c or methylated C nucleotide
gccccgcgcatgggctccgtccgcgg

SEQ ID NO: 529 - DNA, 26 bp, Artificial
  synthetic oligonucleotide
  modified_base (2)..(2): c or methylated C nucleotide
  modified_base (4)..(4): c or methylated C nucleotide
ccgcgcatgggctccgtccgcgggcc

SEQ ID NO: 530 - DNA, 24 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatggg

SEQ ID NO: 531 - DNA, 22 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcgcatggg

SEQ ID NO: 532 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatggg

SEQ ID NO: 533 - DNA, 18 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
gttcgccccgcgcatggg

SEQ ID NO: 534 - DNA, 16 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
tcgccccgcgcatggg

SEQ ID NO: 535 - DNA, 15 bp, Artificial
  synthetic oligonucleotide
  modified_base (1)..(1): c or methylated C nucleotide
  modified_base (6)..(6): c or methylated C nucleotide
  modified_base (8)..(8): c or methylated C nucleotide
cgccccgcgcatggg

SEQ ID NO: 536 - DNA, 24 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatg

SEQ ID NO: 537 - DNA, 22 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgca

SEQ ID NO: 538 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 539 - DNA, 18 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
ggcgcgcggttcgccccg

SEQ ID NO: 540 - DNA, 16 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgccc

SEQ ID NO: 541 - DNA, 15 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgcc

SEQ ID NO: 542 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcccggttcgccccgcgcatggg

SEQ ID NO: 543 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgctccgcgcatggg

SEQ ID NO: 544 - DNA, 26 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcagttcgccccgcgcatggg

SEQ ID NO: 545 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggt

SEQ ID NO: 546 - DNA, 28 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (21)..(21): c or methylated C nucleotide
  modified_base (23)..(23): c or methylated C nucleotide
  modified_base (25)..(25): c or methylated C nucleotide
aggcggggcgggggcgggggcgcgcggt

SEQ ID NO: 547 - DNA, 29 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (22)..(22): c or methylated C nucleotide
  modified_base (24)..(24): c or methylated C nucleotide
  modified_base (26)..(26): c or methylated C nucleotide
gaggcggggcgggggcgggggcgcgcggt

SEQ ID NO: 548 - DNA, 30 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgcggt

SEQ ID NO: 549 - DNA, 31 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (24)..(24): c or methylated C nucleotide
  modified_base (26)..(26): c or methylated C nucleotide
  modified_base (28)..(28): c or methylated C nucleotide
ccgaggcggggcgggggcgggggcgcgcggt

SEQ ID NO: 550 - DNA, 32 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (25)..(25): c or methylated C nucleotide
  modified_base (27)..(27): c or methylated C nucleotide
  modified_base (29)..(29): c or methylated C nucleotide
gccgaggcggggcgggggcgggggcgcgcggt

SEQ ID NO: 551 - DNA, 28 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggtt

SEQ ID NO: 552 - DNA, 29 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttc

SEQ ID NO: 553 - DNA, 30 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcg

SEQ ID NO: 554 - DNA, 31 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcgc

SEQ ID NO: 555 - DNA, 32 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcggttcgcc

SEQ ID NO: 556 - DNA, 29 bp, Artificial
  synthetic oligonucleotide
  modified_base (4)..(4): c or methylated C nucleotide
  modified_base (9)..(9): c or methylated C nucleotide
  modified_base (15)..(15): c or methylated C nucleotide
  modified_base (21)..(21): c or methylated C nucleotide
  modified_base (23)..(23): c or methylated C nucleotide
  modified_base (25)..(25): c or methylated C nucleotide
aggcggggcgggggcgggggcgcgcggtt

SEQ ID NO: 557 - DNA, 31 bp, Artificial
  synthetic oligonucleotide
  modified_base (5)..(5): c or methylated C nucleotide
  modified_base (10)..(10): c or methylated C nucleotide
  modified_base (16)..(16): c or methylated C nucleotide
  modified_base (22)..(22): c or methylated C nucleotide
  modified_base (24)..(24): c or methylated C nucleotide
  modified_base (26)..(26): c or methylated C nucleotide
gaggcggggcgggggcgggggcgcgcggttc

SEQ ID NO: 558 - DNA, 33 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgcggttcg

SEQ ID NO: 559 - DNA, 35 bp, Artificial
  synthetic oligonucleotide
  modified_base (7)..(7): c or methylated C nucleotide
  modified_base (12)..(12): c or methylated C nucleotide
  modified_base (18)..(18): c or methylated C nucleotide
  modified_base (24)..(24): c or methylated C nucleotide
  modified_base (26)..(26): c or methylated C nucleotide
  modified_base (28)..(28): c or methylated C nucleotide
ccgaggcggggcgggggcgggggcgcgcggttcgc

SEQ ID NO: 560 - DNA, 37 bp, Artificial
  synthetic oligonucleotide
  modified_base (8)..(8): c or methylated C nucleotide
  modified_base (13)..(13): c or methylated C nucleotide
  modified_base (19)..(19): c or methylated C nucleotide
  modified_base (25)..(25): c or methylated C nucleotide
  modified_base (27)..(27): c or methylated C nucleotide
  modified_base (29)..(29): c or methylated C nucleotide
gccgaggcggggcgggggcgggggcgcgcggttcgcc

SEQ ID NO: 561 - DNA, 27 bp, Artificial
  synthetic oligonucleotide
  modified_base (6)..(6): c or methylated C nucleotide
  modified_base (11)..(11): c or methylated C nucleotide
  modified_base (17)..(17): c or methylated C nucleotide
  modified_base (23)..(23): c or methylated C nucleotide
  modified_base (25)..(25): c or methylated C nucleotide
  modified_base (27)..(27): c or methylated C nucleotide
cgaggcggggcgggggcgggggcgcgc

SEQ ID NO: 562 - DNA, 27 bp, Artificial
  synthetic oligonucleotide
  modified_base (9)..(9): c or methylated C nucleotide
  modified_base (14)..(14): c or methylated C nucleotide
  modified_base (20)..(20): c or methylated C nucleotide
  modified_base (26)..(26): c or methylated C nucleotide
ggccgaggcggggcgggggcgggggcg

SEQ ID NO: 563 - DNA, 27 bp, Artificial
  synthetic oligonucleotide
  modified_base (12)..(12): c or methylated C nucleotide
  modified_base (17)..(17): c or methylated C nucleotide
  modified_base (23)..(23): c or methylated C nucleotide
cggggccgaggcggggcgggggcgggg

SEQ ID NO: 564 - DNA, 27 bp, Artificial
  synthetic oligonucleotide
  modified_base (15)..(15): c or methylated C nucleotide
  modified_base (20)..(20): c or methylated C nucleotide
  modified_base (26)..(26): c or methylated C nucleotide
ggccggggccgaggcggggcgggggcg

SEQ ID NO: 565 - DNA, 27 bp, Artificial
  synthetic oligonucleotide
  modified_base (18)..(18): c or methylated C nucleotide
  modified_base (23)..(23): c or methylated C nucleotide
cagggccggggccgaggcggggcgggg

SEQ ID NO: 566 - DNA, 27 bp, Artificial
  synthetic oligonucleotide
  modified_base (5)..(5): c or methylated C nucleotide
  modified_base (11)..(11): c or methylated C nucleotide
  modified_base (17)..(17): c or methylated C nucleotide
  modified_base (19)..(19): c or methylated C nucleotide
  modified_base (21)..(21): c or methylated C nucleotide
ggggcgggggcgggggcgcgcggttcg

SEQ ID NO: 567 - DNA, 27 bp, Artificial
  synthetic oligonucleotide
  modified_base (2)..(2): c or methylated C nucleotide
  modified_base (8)..(8): c or methylated C nucleotide
  modified_base (14)..(14): c or methylated C nucleotide
  modified_base (16)..(16): c or methylated C nucleotide
  modified_base (18)..(18): c or methylated C nucleotide
gcgggggcgggggcgcgcggttcgccc

SEQ ID NO: 568 - DNA, 27 bp, Artificial
  synthetic oligonucleotide
  modified_base (5)..(5): c or methylated C nucleotide
  modified_base (11)..(11): c or methylated C nucleotide
  modified_base (13)..(13): c or methylated C nucleotide
  modified_base (15)..(15): c or methylated C nucleotide
ggggcgggggcgcgcggttcgccccgc

SEQ ID NO: 569 - DNA, 27 bp, Artificial
  synthetic oligonucleotide
  modified_base (2)..(2): c or methylated C nucleotide
  modified_base (8)..(8): c or methylated C nucleotide
  modified_base (10)..(10): c or methylated C nucleotide
  modified_base (12)..(12): c or methylated C nucleotide
gcgggggcgcgcggttcgccccgcgca

SEQ ID NO: 570 - DNA, 27 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
ggggcgcgcggttcgccccgcgcatgg

SEQ ID NO: 571 - DNA, 25 bp, Artificial
  synthetic oligonucleotide
  modified_base (1)..(1): c or methylated C nucleotide
  modified_base (6)..(6): c or methylated C nucleotide
  modified_base (12)..(12): c or methylated C nucleotide
  modified_base (18)..(18): c or methylated C nucleotide
  modified_base (20)..(20): c or methylated C nucleotide
  modified_base (22)..(22): c or methylated C nucleotide
cggggcgggggcgggggcgcgcggt

SEQ ID NO: 572 - DNA, 23 bp, Artificial
  synthetic oligonucleotide
  modified_base (4)..(4): c or methylated C nucleotide
  modified_base (10)..(10): c or methylated C nucleotide
  modified_base (16)..(16): c or methylated C nucleotide
  modified_base (18)..(18): c or methylated C nucleotide
  modified_base (20)..(20): c or methylated C nucleotide
gggcgggggcgggggcgcgcggt

SEQ ID NO: 573 - DNA, 21 bp, Artificial
  synthetic oligonucleotide
  modified_base (2)..(2): c or methylated C nucleotide
  modified_base (8)..(8): c or methylated C nucleotide
  modified_base (14)..(14): c or methylated C nucleotide
  modified_base (16)..(16): c or methylated C nucleotide
  modified_base (18)..(18): c or methylated C nucleotide
gcgggggcgggggcgcgcggt

SEQ ID NO: 574 - DNA, 19 bp, Artificial
  synthetic oligonucleotide
  modified_base (6)..(6): c or methylated C nucleotide
  modified_base (12)..(12): c or methylated C nucleotide
  modified_base (14)..(14): c or methylated C nucleotide
  modified_base (16)..(16): c or methylated C nucleotide
gggggcgggggcgcgcggt

SEQ ID NO: 575 - DNA, 17 bp, Artificial
  synthetic oligonucleotide
  modified_base (4)..(4): c or methylated C nucleotide
  modified_base (10)..(10): c or methylated C nucleotide
  modified_base (12)..(12): c or methylated C nucleotide
  modified_base (14)..(14): c or methylated C nucleotide
gggcgggggcgcgcggt

SEQ ID NO: 576 - DNA, 15 bp, Artificial
  synthetic oligonucleotide
  modified_base (2)..(2): c or methylated C nucleotide
  modified_base (8)..(8): c or methylated C nucleotide
  modified_base (10)..(10): c or methylated C nucleotide
  modified_base (12)..(12): c or methylated C nucleotide
gcgggggcgcgcggt

SEQ ID NO: 577 - DNA, 25 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggggcgcgcg

SEQ ID NO: 578 - DNA, 23 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
ggcggggcgggggcgggggcgcg

SEQ ID NO: 579 - DNA, 21 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
ggcggggcgggggcgggggcg

SEQ ID NO: 580 - DNA, 19 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcggggg

SEQ ID NO: 581 - DNA, 17 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcggg

SEQ ID NO: 582 - DNA, 15 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
ggcggggcgggggcg

SEQ ID NO: 583 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcgaggcgggggcgggggcgcgcggt

SEQ ID NO: 584 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgggggcgggtgcgcgcggt

SEQ ID NO: 585 - DNA, 27 bp, Artificial
  synthetic oligonucleotide
  modified_base (3)..(3): c or methylated C nucleotide
  modified_base (8)..(8): c or methylated C nucleotide
  modified_base (14)..(14): c or methylated C nucleotide
  modified_base (20)..(20): c or methylated C nucleotide
  modified_base (22)..(22): c or methylated C nucleotide
  modified_base (24)..(24): c or methylated C nucleotide
ggcggggcgcgggcgggggcgcgcggt

SEQ ID NO: 586 - DNA, 32 bp, Artificial; identical to SEQ ID NO: 472
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide

SEQ ID NO: 587 - DNA, 33 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (24)..(24): c or methylated C nucleotide
  modified_base (28)..(28): c or methylated C nucleotide
  modified_base (31)..(31): c or methylated C nucleotide
cccgccgccgccgccgccgcttacgcccgccgg

SEQ ID NO: 588 - DNA, 34 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (25)..(25): c or methylated C nucleotide
  modified_base (29)..(29): c or methylated C nucleotide
  modified_base (32)..(32): c or methylated C nucleotide
acccgccgccgccgccgccgcttacgcccgccgg

SEQ ID NO: 589 - DNA, 35 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
  modified_base (33)..(33): c or methylated C nucleotide
cacccgccgccgccgccgccgcttacgcccgccgg

SEQ ID NO: 590 - DNA, 36 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (21)..(21): c or methylated C nucleotide
  modified_base (27)..(27): c or methylated C nucleotide
  modified_base (31)..(31): c or methylated C nucleotide
  modified_base (34)..(34): c or methylated C nucleotide
ccacccgccgccgccgccgccgcttacgcccgccgg

SEQ ID NO: 591 - DNA, 37 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (22)..(22): c or methylated C nucleotide
  modified_base (28)..(28): c or methylated C nucleotide
  modified_base (32)..(32): c or methylated C nucleotide
  modified_base (35)..(35): c or methylated C nucleotide
cccacccgccgccgccgccgccgcttacgcccgccgg

SEQ ID NO: 592 - DNA, 33 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggc

SEQ ID NO: 593 - DNA, 34 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggcc

SEQ ID NO: 594 - DNA, 35 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggccc

SEQ ID NO: 595 - DNA, 36 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggcccc

SEQ ID NO: 596 - DNA, 37 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgccggccccg

SEQ ID NO: 597 - DNA, 34 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (24)..(24): c or methylated C nucleotide
  modified_base (28)..(28): c or methylated C nucleotide
  modified_base (31)..(31): c or methylated C nucleotide
cccgccgccgccgccgccgcttacgcccgccggc

SEQ ID NO: 598 - DNA, 36 bp, Artificial
  synthetic oligonucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (25)..(25): c or methylated C nucleotide
  modified_base (29)..(29): c or methylated C nucleotide
  modified_base (32)..(32): c or methylated C nucleotide
acccgccgccgccgccgccgcttacgcccgccggcc

SEQ ID NO: 599 - DNA, 38 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
  modified_base (33)..(33): c or methylated C nucleotide
cacccgccgccgccgccgccgcttacgcccgccggccc

SEQ ID NO: 600 - DNA, 40 bp, Artificial
  synthetic oligonucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (18)..(18): c or methylated C nucleotide
  modified_base (21)..(21): c or methylated C nucleotide
  modified_base (27)..(27): c or methylated C nucleotide
  modified_base (31)..(31): c or methylated C nucleotide
  modified_base (34)..(34): c or methylated C nucleotide
ccacccgccgccgccgccgccgcttacgcccgccggcccc

SEQ ID NO: 601 - DNA, 42 bp, Artificial
  synthetic oligonucleotide
  modified_base (7)..(7): c or methylated C nucleotide
  modified_base (10)..(10): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (22)..(22): c or methylated C nucleotide
  modified_base (28)..(28): c or methylated C nucleotide
  modified_base (32)..(32): c or methylated C nucleotide
  modified_base (35)..(35): c or methylated C nucleotide
cccacccgccgccgccgccgccgcttacgcccgccggccccg

SEQ ID NO: 602 - DNA, 32 bp, Artificial
  synthetic oligonucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (26)..(26): c or methylated C nucleotide
  modified_base (30)..(30): c or methylated C nucleotide
cacccgccgccgccgccgccgcttacgcccgc

SEQ ID NO: 603 - DNA, 32 bp, Artificial
  synthetic oligonucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (29)..(29): c or methylated C nucleotide
acccacccgccgccgccgccgccgcttacgcc

SEQ ID NO: 604 - DNA, 32 bp, Artificial
  synthetic oligonucleotide
  modified_base (11)..(11): c or methylated C nucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (32)..(32): c or methylated C nucleotide
cccacccacccgccgccgccgccgccgcttac

SEQ ID NO: 605 - DNA, 32 bp, Artificial
  synthetic oligonucleotide
  modified_base (14)..(14): c or methylated C nucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (29)..(29): c or methylated C nucleotide
ggccccacccacccgccgccgccgccgccgct

SEQ ID NO: 606 - DNA, 32 bp, Artificial
  synthetic oligonucleotide
  modified_base (17)..(17): c or methylated C nucleotide
  modified_base (20)..(20): c or methylated C nucleotide
  modified_base (23)..(23): c or methylated C nucleotide
  modified_base (26)..(26): c or methylated C nucleotide
  modified_base (29)..(29): c or methylated C nucleotide
  modified_base (32)..(32): c or methylated C nucleotide
cccggccccacccacccgccgccgccgccgcc

SEQ ID NO: 607 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (20)..(20): c or methylated C nucleotide
  modified_base (24)..(24): c or methylated C nucleotide
  modified_base (27)..(27): c or methylated C nucleotide
ccgccgccgccgccgcttacgcccgccggccc

SEQ ID NO: 608 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (17)..(17): c or methylated C nucleotide
  modified_base (21)..(21): c or methylated C nucleotide
  modified_base (24)..(24): c or methylated C nucleotide
ccgccgccgccgcttacgcccgccggccccgc

SEQ ID NO: 609 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (14)..(14): c or methylated C nucleotide
  modified_base (18)..(18): c or methylated C nucleotide
  modified_base (21)..(21): c or methylated C nucleotide
ccgccgccgcttacgcccgccggccccgcgcc

SEQ ID NO: 610 - DNA, 32 bp, Artificial
  synthetic oligonucleotide
  modified_base (2)..(2): c or methylated C nucleotide
  modified_base (5)..(5): c or methylated C nucleotide
  modified_base (11)..(11): c or methylated C nucleotide
  modified_base (15)..(15): c or methylated C nucleotide
  modified_base (18)..(18): c or methylated C nucleotide
ccgccgcttacgcccgccggccccgcgccccc

SEQ ID NO: 611 - DNA, 32 bp, Artificial
  synthetic oligonucleotide
  modified_base (2)..(2): c or methylated C nucleotide
  modified_base (8)..(8): c or methylated C nucleotide
  modified_base (12)..(12): c or methylated C nucleotide
  modified_base (15)..(15): c or methylated C nucleotide
ccgcttacgcccgccggccccgcgcccccggc

SEQ ID NO: 612 - DNA, 30 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (12)..(12): c or methylated C nucleotide
  modified_base (15)..(15): c or methylated C nucleotide
  modified_base (21)..(21): c or methylated C nucleotide
  modified_base (25)..(25): c or methylated C nucleotide
  modified_base (28)..(28): c or methylated C nucleotide
gccgccgccgccgccgcttacgcccgccgg

SEQ ID NO: 613 - DNA, 28 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (10)..(10): c or methylated C nucleotide
  modified_base (13)..(13): c or methylated C nucleotide
  modified_base (19)..(19): c or methylated C nucleotide
  modified_base (23)..(23): c or methylated C nucleotide
  modified_base (26)..(26): c or methylated C nucleotide
cgccgccgccgccgcttacgcccgccgg

SEQ ID NO: 614 - DNA, 26 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (17)..(17): c or methylated C nucleotide
  modified_base (21)..(21): c or methylated C nucleotide
  modified_base (24)..(24): c or methylated C nucleotide
ccgccgccgccgcttacgcccgccgg

SEQ ID NO: 615 - DNA, 24 bp, Artificial
  synthetic oligonucleotide
  modified_base (3)..(3): c or methylated C nucleotide
  modified_base (6)..(6): c or methylated C nucleotide
  modified_base (9)..(9): c or methylated C nucleotide
  modified_base (15)..(15): c or methylated C nucleotide
  modified_base (19)..(19): c or methylated C nucleotide
  modified_base (22)..(22): c or methylated C nucleotide
gccgccgccgcttacgcccgccgg

SEQ ID NO: 616 - DNA, 22 bp, Artificial
  synthetic oligonucleotide
  modified_base (1)..(1): c or methylated C nucleotide
  modified_base (4)..(4): c or methylated C nucleotide
  modified_base (7)..(7): c or methylated C nucleotide
  modified_base (13)..(13): c or methylated C nucleotide
  modified_base (17)..(17): c or methylated C nucleotide
  modified_base (20)..(20): c or methylated C nucleotide
cgccgccgcttacgcccgccgg

SEQ ID NO: 617 - DNA, 20 bp, Artificial
  synthetic oligonucleotide
  modified_base (2)..(2): c or methylated C nucleotide
  modified_base (5)..(5): c or methylated C nucleotide
  modified_base (11)..(11): c or methylated C nucleotide
  modified_base (15)..(15): c or methylated C nucleotide
  modified_base (18)..(18): c or methylated C nucleotide
ccgccgcttacgcccgccgg

SEQ ID NO: 618 - DNA, 18 bp, Artificial
  synthetic oligonucleotide
  modified_base (3)..(3): c or methylated C nucleotide
  modified_base (9)..(9): c or methylated C nucleotide
  modified_base (13)..(13): c or methylated C nucleotide
  modified_base (16)..(16): c or methylated C nucleotide
gccgcttacgcccgccgg

SEQ ID NO: 619 - DNA, 16 bp, Artificial
  synthetic oligonucleotide
  modified_base (1)..(1): c or methylated C nucleotide
  modified_base (7)..(7): c or methylated C nucleotide
  modified_base (11)..(11): c or methylated C nucleotide
  modified_base (14)..(14): c or methylated C nucleotide
cgcttacgcccgccgg

SEQ ID NO: 620 - DNA, 15 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
gcttacgcccgccgg

SEQ ID NO: 621 - DNA, 30 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttacgcccgcc

SEQ ID NO: 622 - DNA, 28 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
ccgccgccgccgccgccgcttacgcccg

SEQ ID NO: 623 - DNA, 26 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
ccgccgccgccgccgccgcttacgcc

SEQ ID NO: 624 - DNA, 24 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
ccgccgccgccgccgccgcttacg

SEQ ID NO: 625 - DNA, 22 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccgctta

SEQ ID NO: 626 - DNA, 20 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccgct

SEQ ID NO: 627 - DNA, 18 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
ccgccgccgccgccgccg

SEQ ID NO: 628 - DNA, 16 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
ccgccgccgccgccgc

SEQ ID NO: 629 - DNA, 15 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
ccgccgccgccgccg

SEQ ID NO: 630 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccaccgccgccgcttacgcccgccgg

SEQ ID NO: 631 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccgccgcttccgcccgccgg

SEQ ID NO: 632 - DNA, 32 bp, Artificial
  synthetic oligonucleotide
  modified_base (2)..(2): c or methylated C nucleotide
  modified_base (5)..(5): c or methylated C nucleotide
  modified_base (8)..(8): c or methylated C nucleotide
  modified_base (11)..(11): c or methylated C nucleotide
  modified_base (14)..(14): c or methylated C nucleotide
  modified_base (17)..(17): c or methylated C nucleotide
  modified_base (23)..(23): c or methylated C nucleotide
  modified_base (27)..(27): c or methylated C nucleotide
  modified_base (30)..(30): c or methylated C nucleotide
ccgccgccgccgccaccgcttacgcccgccgg

SEQ ID NO: 633 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgct

SEQ ID NO: 634 - DNA, 29 bp, Artificial
  synthetic oligonucleotide
  modified_base (3)..(3): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (26)..(26): c or methylated C nucleotide
cccgcccgccgcagcccccgacgcccgct

SEQ ID NO: 635 - DNA, 30 bp, Artificial
  synthetic oligonucleotide
  modified_base (4)..(4): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (27)..(27): c or methylated C nucleotide
ccccgcccgccgcagcccccgacgcccgct

SEQ ID NO: 636 - DNA, 31 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (28)..(28): c or methylated C nucleotide
cccccgcccgccgcagcccccgacgcccgct

SEQ ID NO: 637 - DNA, 32 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (29)..(29): c or methylated C nucleotide
gcccccgcccgccgcagcccccgacgcccgct

SEQ ID NO: 638 - DNA, 33 bp, Artificial
  synthetic oligonucleotide
  modified_base (7)..(7): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (30)..(30): c or methylated C nucleotide
ggcccccgcccgccgcagcccccgacgcccgct

SEQ ID NO: 639 - DNA, 29 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctc

SEQ ID NO: 640 - DNA, 30 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctca

SEQ ID NO: 641 - DNA, 31 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcac

SEQ ID NO: 642 - DNA, 32 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcacc

SEQ ID NO: 643 - DNA, 33 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccgctcacct

SEQ ID NO: 644 - DNA, 30 bp, Artificial
  synthetic oligonucleotide
  modified_base (3)..(3): c or methylated C nucleotide
  modified_base (7)..(7): c or methylated C nucleotide
  modified_base (10)..(10): c or methylated C nucleotide
  modified_base (19)..(19): c or methylated C nucleotide
  modified_base (22)..(22): c or methylated C nucleotide
  modified_base (26)..(26): c or methylated C nucleotide
cccgcccgccgcagcccccgacgcccgctc

SEQ ID NO: 645 - DNA, 32 bp, Artificial
  synthetic oligonucleotide
  modified_base (4)..(4): c or methylated C nucleotide
  modified_base (8)..(8): c or methylated C nucleotide
  modified_base (11)..(11): c or methylated C nucleotide
  modified_base (20)..(20): c or methylated C nucleotide
  modified_base (23)..(23): c or methylated C nucleotide
  modified_base (27)..(27): c or methylated C nucleotide
ccccgcccgccgcagcccccgacgcccgctca

SEQ ID NO: 646 - DNA, 34 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (21)..(21): c or methylated C nucleotide
  modified_base (24)..(24): c or methylated C nucleotide
  modified_base (28)..(28): c or methylated C nucleotide
cccccgcccgccgcagcccccgacgcccgctcac

SEQ ID NO: 647 - DNA, 36 bp, Artificial
  synthetic oligonucleotide
  modified_base (6)..(6): c or methylated C nucleotide
  modified_base (10)..(10): c or methylated C nucleotide
  modified_base (13)..(13): c or methylated C nucleotide
  modified_base (22)..(22): c or methylated C nucleotide
  modified_base (25)..(25): c or methylated C nucleotide
  modified_base (29)..(29): c or methylated C nucleotide
gcccccgcccgccgcagcccccgacgcccgctcacc

SEQ ID NO: 648 - DNA, 38 bp, Artificial
  synthetic oligonucleotide
  modified_base (7)..(7): c or methylated C nucleotide
  modified_base (11)..(11): c or methylated C nucleotide
  modified_base (14)..(14): c or methylated C nucleotide
  modified_base (23)..(23): c or methylated C nucleotide
  modified_base (26)..(26): c or methylated C nucleotide
  modified_base (30)..(30): c or methylated C nucleotide
ggcccccgcccgccgcagcccccgacgcccgctcacct

SEQ ID NO: 649 - DNA, 28 bp, Artificial
  synthetic oligonucleotide
  modified_base (5)..(5): c or methylated C nucleotide
  modified_base (9)..(9): c or methylated C nucleotide
  modified_base (12)..(12): c or methylated C nucleotide
  modified_base (24)..(24): c or methylated C nucleotide
  modified_base (28)..(28): c or methylated C nucleotide
cccccgcccgccgcagcccccgacgccc

SEQ ID NO: 650 - DNA, 28 bp, Artificial
  synthetic oligonucleotide
  modified_base (8)..(8): c or methylated C nucleotide
  modified_base (12)..(12): c or methylated C nucleotide
  modified_base (15)..(15): c or methylated C nucleotide
  modified_base (24)..(24): c or methylated C nucleotide
  modified_base (27)..(27): c or methylated C nucleotide
gggcccccgcccgccgcagcccccgacg

SEQ ID NO: 651 - DNA, 28 bp, Artificial
  synthetic oligonucleotide
  modified_base (11)..(11): c or methylated C nucleotide
  modified_base (15)..(15): c or methylated C nucleotide
  modified_base (18)..(18): c or methylated C nucleotide
  modified_base (27)..(27): c or methylated C nucleotide
aaggggcccccgcccgccgcagcccccg

SEQ ID NO: 652 - DNA, 28 bp, Artificial
  synthetic oligonucleotide
  modified_base (14)..(14): c or methylated C nucleotide
  modified_base (18)..(18): c or methylated C nucleotide
  modified_base (21)..(21): c or methylated C nucleotide
aggaaggggcccccgcccgccgcagccc

SEQ ID NO: 653 - DNA, 28 bp, Artificial
  synthetic oligonucleotide
  modified_base (17)..(17): c or methylated C nucleotide
  modified_base (21)..(21): c or methylated C nucleotide
  modified_base (24)..(24): c or methylated C nucleotide
gggaggaaggggcccccgcccgccgcag

SEQ ID NO: 654 - DNA, 28 bp, Artificial
  synthetic oligonucleotide
  modified_base (3)..(3): c or methylated C nucleotide
  modified_base (6)..(6): c or methylated C nucleotide
  modified_base (15)..(15): c or methylated C nucleotide
  modified_base (18)..(18): c or methylated C nucleotide
  modified_base (22)..(22): c or methylated C nucleotide
cccgccgcagcccccgacgcccgctcac

SEQ ID NO: 655 - DNA, 28 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (19)..(19): c or methylated C nucleotide
gccgcagcccccgacgcccgctcacctg

SEQ ID NO: 656 - DNA, 28 bp, Artificial
  synthetic oligonucleotide
  modified_base (9)..(9): c or methylated C nucleotide
  modified_base (12)..(12): c or methylated C nucleotide
  modified_base (16)..(16): c or methylated C nucleotide
gcagcccccgacgcccgctcacctgtgc

SEQ ID NO: 657 - DNA, 28 bp, Artificial
  synthetic oligonucleotide
  modified_base (6)..(6): c or methylated C nucleotide
  modified_base (9)..(9): c or methylated C nucleotide
  modified_base (13)..(13): c or methylated C nucleotide
gcccccgacgcccgctcacctgtgcccg

SEQ ID NO: 658 - DNA, 28 bp, Artificial
  synthetic oligonucleotide
  modified_base (3)..(3): c or methylated C nucleotide
  modified_base (6)..(6): c or methylated C nucleotide
  modified_base (10)..(10): c or methylated C nucleotide
cccgacgcccgctcacctgtgcccgcgg

SEQ ID NO: 659 - DNA, 26 bp, Artificial
  synthetic oligonucleotide
  modified_base (4)..(4): c or methylated C nucleotide
  modified_base (7)..(7): c or methylated C nucleotide
  modified_base (16)..(16): c or methylated C nucleotide
  modified_base (19)..(19): c or methylated C nucleotide
  modified_base (23)..(23): c or methylated C nucleotide
gcccgccgcagcccccgacgcccgct

SEQ ID NO: 660 - DNA, 24 bp, Artificial
  synthetic oligonucleotide
  modified_base (2)..(2): c or methylated C nucleotide
  modified_base (5)..(5): c or methylated C nucleotide
  modified_base (14)..(14): c or methylated C nucleotide
  modified_base (17)..(17): c or methylated C nucleotide
  modified_base (21)..(21): c or methylated C nucleotide
ccgccgcagcccccgacgcccgct

SEQ ID NO: 661 - DNA, 22 bp, Artificial
  synthetic oligonucleotide
  modified_base (3)..(3): c or methylated C nucleotide
  modified_base (12)..(12): c or methylated C nucleotide
  modified_base (15)..(15): c or methylated C nucleotide
  modified_base (19)..(19): c or methylated C nucleotide
gccgcagcccccgacgcccgct

SEQ ID NO: 662 - DNA, 20 bp, Artificial
  synthetic oligonucleotide
  modified_base (1)..(1): c or methylated C nucleotide
  modified_base (10)..(10): c or methylated C nucleotide
  modified_base (13)..(13): c or methylated C nucleotide
  modified_base (17)..(17): c or methylated C nucleotide
cgcagcccccgacgcccgct

SEQ ID NO: 663 - DNA, 18 bp, Artificial
  synthetic oligonucleotide
  modified_base (8)..(8): c or methylated C nucleotide
  modified_base (11)..(11): c or methylated C nucleotide
  modified_base (15)..(15): c or methylated C nucleotide
cagcccccgacgcccgct

SEQ ID NO: 664 - DNA, 16 bp, Artificial
  synthetic oligonucleotide
  modified_base (6)..(6): c or methylated C nucleotide
  modified_base (9)..(9): c or methylated C nucleotide
  modified_base (13)..(13): c or methylated C nucleotide
gcccccgacgcccgct

SEQ ID NO: 665 - DNA, 15 bp, Artificial
  synthetic oligonucleotide
  modified_base (5)..(5): c or methylated C nucleotide
  modified_base (8)..(8): c or methylated C nucleotide
  modified_base (12)..(12): c or methylated C nucleotide
cccccgacgcccgct

SEQ ID NO: 666 - DNA, 26 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcccccgacgcccg

SEQ ID NO: 667 - DNA, 24 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ccgcccgccgcagcccccgacgcc

SEQ ID NO: 668 - DNA, 22 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
ccgcccgccgcagcccccgacg

SEQ ID NO: 669 - DNA, 20 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
ccgcccgccgcagcccccga

SEQ ID NO: 670 - DNA, 18 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
ccgcccgccgcagccccc

SEQ ID NO: 671 - DNA, 16 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
ccgcccgccgcagccc

SEQ ID NO: 672 - DNA, 15 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
ccgcccgccgcagcc

SEQ ID NO: 673 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcacgccgcagcccccgacgcccgct

SEQ ID NO: 674 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagccctcgacgcccgct

SEQ ID NO: 675 - DNA, 28 bp, Artificial
  synthetic oligonucleotide
  modified_base (2)..(2): c or methylated C nucleotide
  modified_base (6)..(6): c or methylated C nucleotide
  modified_base (9)..(9): c or methylated C nucleotide
  modified_base (18)..(18): c or methylated C nucleotide
  modified_base (21)..(21): c or methylated C nucleotide
  modified_base (25)..(25): c or methylated C nucleotide
ccgcccgccgcagcgcccgacgcccgct

SEQ ID NO: 676 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccgg

SEQ ID NO: 677 - DNA, 30 bp, Artificial
  synthetic oligonucleotide
  modified_base (3)..(3): c or methylated C nucleotide
  modified_base (5)..(5): c or methylated C nucleotide
  modified_base (11)..(11): c or methylated C nucleotide
  modified_base (18)..(18): c or methylated C nucleotide
  modified_base (28)..(28): c or methylated C nucleotide
tgcgcgccatcgggccccgccccaccccgg

SEQ ID NO: 678 - DNA, 31 bp, Artificial
  synthetic oligonucleotide
  modified_base (4)..(4): c or methylated C nucleotide
  modified_base (6)..(6): c or methylated C nucleotide
  modified_base (12)..(12): c or methylated C nucleotide
  modified_base (19)..(19): c or methylated C nucleotide
  modified_base (29)..(29): c or methylated C nucleotide
ctgcgcgccatcgggccccgccccaccccgg

SEQ ID NO: 679 - DNA, 32 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
  modified_base (30)..(30): c or methylated C nucleotide
gctgcgcgccatcgggccccgccccaccccgg

SEQ ID NO: 680 - DNA, 33 bp, Artificial
  synthetic oligonucleotide
  modified_base (6)..(6): c or methylated C nucleotide
  modified_base (8)..(8): c or methylated C nucleotide
  modified_base (14)..(14): c or methylated C nucleotide
  modified_base (21)..(21): c or methylated C nucleotide
  modified_base (31)..(31): c or methylated C nucleotide
ggctgcgcgccatcgggccccgccccaccccgg

SEQ ID NO: 681 - DNA, 34 bp, Artificial
  synthetic oligonucleotide
  modified_base (7)..(7): c or methylated C nucleotide
  modified_base (9)..(9): c or methylated C nucleotide
  modified_base (15)..(15): c or methylated C nucleotide
  modified_base (22)..(22): c or methylated C nucleotide
  modified_base (32)..(32): c or methylated C nucleotide
tggctgcgcgccatcgggccccgccccaccccgg

SEQ ID NO: 682 - DNA, 30 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (26)..(26): c or methylated C nucleotide
gcgcgccatcgggccccgccccaccccggt

SEQ ID NO: 683 - DNA, 31 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggtt

SEQ ID NO: 684 - DNA, 32 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttg

SEQ ID NO: 685 - DNA, 33 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttgg

SEQ ID NO: 686 - DNA, 34 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccaccccggttggc

SEQ ID NO: 687 - DNA, 31 bp, Artificial
  synthetic oligonucleotide
  modified_base (3)..(3): c or methylated C nucleotide
  modified_base (5)..(5): c or methylated C nucleotide
  modified_base (11)..(11): c or methylated C nucleotide
  modified_base (18)..(18): c or methylated C nucleotide
  modified_base (28)..(28): c or methylated C nucleotide
tgcgcgccatcgggccccgccccaccccggt

SEQ ID NO: 688 - DNA, 33 bp, Artificial
  synthetic oligonucleotide
  modified_base (4)..(4): c or methylated C nucleotide
  modified_base (6)..(6): c or methylated C nucleotide
  modified_base (12)..(12): c or methylated C nucleotide
  modified_base (19)..(19): c or methylated C nucleotide
  modified_base (29)..(29): c or methylated C nucleotide
ctgcgcgccatcgggccccgccccaccccggtt

SEQ ID NO: 689 - DNA, 35 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
  modified_base (30)..(30): c or methylated C nucleotide
gctgcgcgccatcgggccccgccccaccccggttg

SEQ ID NO: 690 - DNA, 37 bp, Artificial
  synthetic oligonucleotide
  modified_base (6)..(6): c or methylated C nucleotide
  modified_base (8)..(8): c or methylated C nucleotide
  modified_base (14)..(14): c or methylated C nucleotide
  modified_base (21)..(21): c or methylated C nucleotide
  modified_base (31)..(31): c or methylated C nucleotide
ggctgcgcgccatcgggccccgccccaccccggttgg

SEQ ID NO: 691 - DNA, 39 bp, Artificial
  synthetic oligonucleotide
  modified_base (7)..(7): c or methylated C nucleotide
  modified_base (9)..(9): c or methylated C nucleotide
  modified_base (15)..(15): c or methylated C nucleotide
  modified_base (22)..(22): c or methylated C nucleotide
  modified_base (32)..(32): c or methylated C nucleotide
tggctgcgcgccatcgggccccgccccaccccggttggc

SEQ ID NO: 692 - DNA, 29 bp, Artificial
  synthetic oligonucleotide
  modified_base (5)..(5): c or methylated C nucleotide
  modified_base (7)..(7): c or methylated C nucleotide
  modified_base (13)..(13): c or methylated C nucleotide
  modified_base (20)..(20): c or methylated C nucleotide
gctgcgcgccatcgggccccgccccaccc

SEQ ID NO: 693 - DNA, 29 bp, Artificial
  synthetic oligonucleotide
  modified_base (8)..(8): c or methylated C nucleotide
  modified_base (10)..(10): c or methylated C nucleotide
  modified_base (16)..(16): c or methylated C nucleotide
  modified_base (23)..(23): c or methylated C nucleotide
ttggctgcgcgccatcgggccccgcccca

SEQ ID NO: 694 - DNA, 29 bp, Artificial
  synthetic oligonucleotide
  modified_base (11)..(11): c or methylated C nucleotide
  modified_base (13)..(13): c or methylated C nucleotide
  modified_base (19)..(19): c or methylated C nucleotide
  modified_base (26)..(26): c or methylated C nucleotide
ccattggctgcgcgccatcgggccccgcc

SEQ ID NO: 695 - DNA, 29 bp, Artificial
  synthetic oligonucleotide
  modified_base (14)..(14): c or methylated C nucleotide
  modified_base (16)..(16): c or methylated C nucleotide
  modified_base (22)..(22): c or methylated C nucleotide
  modified_base (29)..(29): c or methylated C nucleotide
ctaccattggctgcgcgccatcgggcccc

SEQ ID NO: 696 - DNA, 29 bp, Artificial
  synthetic oligonucleotide
  modified_base (17)..(17): c or methylated C nucleotide
  modified_base (19)..(19): c or methylated C nucleotide
  modified_base (25)..(25): c or methylated C nucleotide
ggcctaccattggctgcgcgccatcgggc

SEQ ID NO: 697 - DNA, 29 bp, Artificial
  synthetic oligonucleotide
  modified_base (1)..(1): c or methylated C nucleotide
  modified_base (7)..(7): c or methylated C nucleotide
  modified_base (14)..(14): c or methylated C nucleotide
  modified_base (24)..(24): c or methylated C nucleotide
cgccatcgggccccgccccaccccggttg

SEQ ID NO: 698 - DNA, 29 bp, Artificial
  synthetic oligonucleotide
  modified_base (4)..(4): c or methylated C nucleotide
  modified_base (11)..(11): c or methylated C nucleotide
  modified_base (21)..(21): c or methylated C nucleotide
catcgggccccgccccaccccggttggct

SEQ ID NO: 699 - DNA, 29 bp, Artificial
  synthetic oligonucleotide
  modified_base (1)..(1): c or methylated C nucleotide
  modified_base (8)..(8): c or methylated C nucleotide
  modified_base (18)..(18): c or methylated C nucleotide
cgggccccgccccaccccggttggctgag

SEQ ID NO: 700 - DNA, 29 bp, Artificial
  synthetic oligonucleotide
  modified_base (5)..(5): c or methylated C nucleotide
  modified_base (15)..(15): c or methylated C nucleotide
gccccgccccaccccggttggctgagcgg

SEQ ID NO: 701 - DNA, 29 bp, Artificial
  synthetic oligonucleotide
  modified_base (2)..(2): c or methylated C nucleotide
  modified_base (12)..(12): c or methylated C nucleotide
ccgccccaccccggttggctgagcggccc

SEQ ID NO: 702 - DNA, 27 bp, Artificial
  synthetic oligonucleotide
  modified_base (2)..(2): c or methylated C nucleotide
  modified_base (8)..(8): c or methylated C nucleotide
  modified_base (15)..(15): c or methylated C nucleotide
  modified_base (25)..(25): c or methylated C nucleotide
gcgccatcgggccccgccccaccccgg

SEQ ID NO: 703 - DNA, 25 bp, Artificial
  synthetic oligonucleotide
  modified_base (6)..(6): c or methylated C nucleotide
  modified_base (13)..(13): c or methylated C nucleotide
  modified_base (23)..(23): c or methylated C nucleotide
gccatcgggccccgccccaccccgg

SEQ ID NO: 704 - DNA, 23 bp, Artificial
  synthetic oligonucleotide
  modified_base (4)..(4): c or methylated C nucleotide
  modified_base (11)..(11): c or methylated C nucleotide
  modified_base (21)..(21): c or methylated C nucleotide
catcgggccccgccccaccccgg

SEQ ID NO: 705 - DNA, 21 bp, Artificial
  synthetic oligonucleotide
  modified_base (2)..(2): c or methylated C nucleotide
  modified_base (9)..(9): c or methylated C nucleotide
  modified_base (19)..(19): c or methylated C nucleotide
tcgggccccgccccaccccgg

SEQ ID NO: 706 - DNA, 19 bp, Artificial
  synthetic oligonucleotide
  modified_base (7)..(7): c or methylated C nucleotide
  modified_base (17)..(17): c or methylated C nucleotide
gggccccgccccaccccgg

SEQ ID NO: 707 - DNA, 17 bp, Artificial
  synthetic oligonucleotide
  modified_base (5)..(5): c or methylated C nucleotide
  modified_base (15)..(15): c or methylated C nucleotide
gccccgccccaccccgg

SEQ ID NO: 708 - DNA, 15 bp, Artificial
  synthetic oligonucleotide
  modified_base (3)..(3): c or methylated C nucleotide
  modified_base (13)..(13): c or methylated C nucleotide
cccgccccaccccgg

SEQ ID NO: 709 - DNA, 27 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccccacccc

SEQ ID NO: 710 - DNA, 25 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgccccacc

SEQ ID NO: 711 - DNA, 23 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgcccca

SEQ ID NO: 712 - DNA, 21 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgccc

SEQ ID NO: 713 - DNA, 19 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggccccgc

SEQ ID NO: 714 - DNA, 17 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
gcgcgccatcgggcccc

SEQ ID NO: 715 - DNA, 15 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
gcgcgccatcgggcc

SEQ ID NO: 716 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggcaccgccccaccccgg

SEQ ID NO: 717 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgccatcgggccccgccctaccccgg

SEQ ID NO: 718 - DNA, 29 bp, Artificial
  synthetic oligonucleotide
  modified_base (2)..(2): c or methylated C nucleotide
  modified_base (4)..(4): c or methylated C nucleotide
  modified_base (10)..(10): c or methylated C nucleotide
  modified_base (17)..(17): c or methylated C nucleotide
  modified_base (27)..(27): c or methylated C nucleotide
gcgcgcgatcgggccccgccccaccccgg

SEQ ID NO: 719 - DNA, 40 bp, Artificial; identical to SEQ ID NO: 469
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide

SEQ ID NO: 720 - DNA, 41 bp, Artificial
  synthetic oligonucleotide
  modified_base (14)..(14): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (28)..(28): c or methylated C nucleotide
  modified_base (30)..(30): c or methylated C nucleotide
gcgggggcgggggcgcgcggttcgccccgcgcatgggctcc

SEQ ID NO: 721 - DNA, 42 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
  modified_base (29)..(29): c or methylated C nucleotide
  modified_base (31)..(31): c or methylated C nucleotide
ggcgggggcgggggcgcgcggttcgccccgcgcatgggctcc

SEQ ID NO: 722 - DNA, 43 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggctcc

SEQ ID NO: 723 - DNA, 44 bp, Artificial
  synthetic oligonucleotide
  modified_base (17)..(17): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (31)..(31): c or methylated C nucleotide
  modified_base (33)..(33): c or methylated C nucleotide
cgggcgggggcgggggcgcgcggttcgccccgcgcatgggctcc

SEQ ID NO: 724 - DNA, 45 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
  modified_base (27)..(27): c or methylated C nucleotide
  modified_base (32)..(32): c or methylated C nucleotide
  modified_base (34)..(34): c or methylated C nucleotide
gcgggcgggggcgggggcgcgcggttcgccccgcgcatgggctcc

SEQ ID NO: 725 - DNA, 41 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccg

SEQ ID NO: 726 - DNA, 42 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgt

SEQ ID NO: 727 - DNA, 43 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtc

SEQ ID NO: 728 - DNA, 44 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtcc

SEQ ID NO: 729 - DNA, 45 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggctccgtccg

SEQ ID NO: 730 - DNA, 42 bp, Artificial
  synthetic oligonucleotide
  modified_base (14)..(14): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (28)..(28): c or methylated C nucleotide
  modified_base (30)..(30): c or methylated C nucleotide
gcgggggcgggggcgcgcggttcgccccgcgcatgggctccg

SEQ ID NO: 731 - DNA, 44 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
  modified_base (24)..(24): c or methylated C nucleotide
  modified_base (29)..(29): c or methylated C nucleotide
  modified_base (31)..(31): c or methylated C nucleotide
ggcgggggcgggggcgcgcggttcgccccgcgcatgggctccgt

SEQ ID NO: 732 - DNA, 46 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggctccgtc

SEQ ID NO: 733 - DNA, 48 bp, Artificial
  synthetic oligonucleotide
  modified_base (17)..(17): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (31)..(31): c or methylated C nucleotide
  modified_base (33)..(33): c or methylated C nucleotide
cgggcgggggcgggggcgcgcggttcgccccgcgcatgggctccgtcc

SEQ ID NO: 734 - DNA, 50 bp, Artificial
  synthetic oligonucleotide
  modified_base (18)..(18): c or methylated C nucleotide
  modified_base (20)..(20): c or methylated C nucleotide
  modified_base (22)..(22): c or methylated C nucleotide
  modified_base (27)..(27): c or methylated C nucleotide
  modified_base (32)..(32): c or methylated C nucleotide
  modified_base (34)..(34): c or methylated C nucleotide
gcgggcgggggcgggggcgcgcggttcgccccgcgcatgggctccgtccg

SEQ ID NO: 735 - DNA, 40 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (25)..(25): c or methylated C nucleotide
  modified_base (30)..(30): c or methylated C nucleotide
  modified_base (32)..(32): c or methylated C nucleotide
gggcgggggcgggggcgcgcggttcgccccgcgcatgggc

SEQ ID NO: 736 - DNA, 40 bp, Artificial
  synthetic oligonucleotide
  modified_base (19)..(19): c or methylated C nucleotide
  modified_base (21)..(21): c or methylated C nucleotide
  modified_base (23)..(23): c or methylated C nucleotide
  modified_base (28)..(28): c or methylated C nucleotide
  modified_base (33)..(33): c or methylated C nucleotide
  modified_base (35)..(35): c or methylated C nucleotide
ggcgggcgggggcgggggcgcgcggttcgccccgcgcatg

SEQ ID NO: 737 - DNA, 40 bp, Artificial
  synthetic oligonucleotide
  modified_base (22)..(22): c or methylated C nucleotide
  modified_base (24)..(24): c or methylated C nucleotide
  modified_base (26)..(26): c or methylated C nucleotide
  modified_base (31)..(31): c or methylated C nucleotide
  modified_base (36)..(36): c or methylated C nucleotide
  modified_base (38)..(38): c or methylated C nucleotide
gggggcgggcgggggcgggggcgcgcggttcgccccgcgc

SEQ ID NO: 738 - DNA, 40 bp, Artificial
  synthetic oligonucleotide
  modified_base (25)..(25): c or methylated C nucleotide
  modified_base (27)..(27): c or methylated C nucleotide
  modified_base (29)..(29): c or methylated C nucleotide
  modified_base (34)..(34): c or methylated C nucleotide
  modified_base (39)..(39): c or methylated C nucleotide
ggcgggggcgggcgggggcgggggcgcgcggttcgccccg

SEQ ID NO: 739 - DNA, 40 bp, Artificial
  synthetic oligonucleotide
  modified_base (26)..(26): c or methylated C nucleotide
  modified_base (30)..(30): c or methylated C nucleotide
  modified_base (32)..(32): c or methylated C nucleotide
  modified_base (37)..(37): c or methylated C nucleotide
cggggcgggggcgggcgggggcgggggcgcgcggttcgcc

SEQ ID NO: 740 - DNA, 40 bp, Artificial
  synthetic oligonucleotide
  modified_base (10)..(10): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
gggcgggggcgcgcggttcgccccgcgcatgggctccgtc

SEQ ID NO: 741 - DNA, 40 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatgggctccgtccgc

SEQ ID NO: 742 - DNA, 40 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgcatgggctccgtccgcggc

SEQ ID NO: 743 - DNA, 40 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatgggctccgtccgcggcggg

SEQ ID NO: 744 - DNA, 40 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
gcggttcgccccgcgcatgggctccgtccgcggcgggtgc

SEQ ID NO: 745 - DNA, 38 bp, Artificial
  synthetic oligonucleotide
  modified_base (11)..(11): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
ggggcgggggcgcgcggttcgccccgcgcatgggctcc

SEQ ID NO: 746 - DNA, 36 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
ggcgggggcgcgcggttcgccccgcgcatgggctcc

SEQ ID NO: 747 - DNA, 34 bp, Artificial; identical to SEQ ID NO: 518
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide

SEQ ID NO: 748 - DNA, 32 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgcatgggctcc

SEQ ID NO: 749 - DNA, 30 bp, Artificial; identical to SEQ ID NO: 513
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide

SEQ ID NO: 750 - DNA, 28 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcgcatgggctcc

SEQ ID NO: 751 - DNA, 26 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcgcatgggctcc

SEQ ID NO: 752 - DNA, 24 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatgggctcc

SEQ ID NO: 753 - DNA, 22 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
gttcgccccgcgcatgggctcc

SEQ ID NO: 754 - DNA, 20 bp, Artificial
  synthetic oligonucleotide
  modified_base (2)..(2): c or methylated C nucleotide
  modified_base (7)..(7): c or methylated C nucleotide
  modified_base (9)..(9): c or methylated C nucleotide
tcgccccgcgcatgggctcc

SEQ ID NO: 755 - DNA, 18 bp, Artificial
  synthetic oligonucleotide
  modified_base (5)..(5): c or methylated C nucleotide
  modified_base (7)..(7): c or methylated C nucleotide
gccccgcgcatgggctcc

SEQ ID NO: 756 - DNA, 16 bp, Artificial
  synthetic oligonucleotide
  modified_base (3)..(3): c or methylated C nucleotide
  modified_base (5)..(5): c or methylated C nucleotide
cccgcgcatgggctcc

SEQ ID NO: 757 - DNA, 15 bp, Artificial
  synthetic oligonucleotide
  modified_base (3)..(3): c or methylated C nucleotide
  modified_base (5)..(5): c or methylated C nucleotide
cccgcgcatgggctc

SEQ ID NO: 758 - DNA, 38 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatgggct

SEQ ID NO: 759 - DNA, 36 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatggg

SEQ ID NO: 760 - DNA, 34 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgcatg

SEQ ID NO: 761 - DNA, 32 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcgca

SEQ ID NO: 762 - DNA, 30 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcg

SEQ ID NO: 763 - DNA, 28 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
cgggggcgggggcgcgcggttcgccccg

SEQ ID NO: 764 - DNA, 26 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttcgccc

SEQ ID NO: 765 - DNA, 24 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttcgc

SEQ ID NO: 766 - DNA, 22 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
cgggggcgggggcgcgcggttc

SEQ ID NO: 767 - DNA, 20 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
cgggggcgggggcgcgcggt

SEQ ID NO: 768 - DNA, 18 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
cgggggcgggggcgcgcg

SEQ ID NO: 769 - DNA, 16 bp, Artificial
  synthetic oligonucleotide
  modified_base (13)..(13): c or methylated C nucleotide
  modified_base (15)..(15): c or methylated C nucleotide
cgggggcgggggcgcg

SEQ ID NO: 770 - DNA, 15 bp, Artificial
  synthetic oligonucleotide
  modified_base (13)..(13): c or methylated C nucleotide
  modified_base (15)..(15): c or methylated C nucleotide
cgggggcgggggcgc

SEQ ID NO: 771 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcaggggcgcgcggttcgccccgcgcatgggctcc

SEQ ID NO: 772 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcgtttcgccccgcgcatgggctcc

SEQ ID NO: 773 - DNA, 40 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
cgggggcgggggcgcgcggttcgccccgcacatgggctcc

SEQ ID NO: 774 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcg

SEQ ID NO: 775 - DNA, 21 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcg

SEQ ID NO: 776 - DNA, 22 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcg

SEQ ID NO: 777 - DNA, 23 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcg

SEQ ID NO: 778 - DNA, 24 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcg

SEQ ID NO: 779 - DNA, 25 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcg

SEQ ID NO: 780 - DNA, 21 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgc

SEQ ID NO: 781 - DNA, 22 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgca

SEQ ID NO: 782 - DNA, 23 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcat

SEQ ID NO: 783 - DNA, 24 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatg

SEQ ID NO: 784 - DNA, 25 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccccgcgcatgg

SEQ ID NO: 785 - DNA, 22 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
gggcgcgcggttcgccccgcgc

SEQ ID NO: 786 - DNA, 24 bp, Artificial
  synthetic oligonucleotide
  modified_base (5)..(5): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
ggggcgcgcggttcgccccgcgca

SEQ ID NO: 787 - DNA, 26 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
gggggcgcgcggttcgccccgcgcat

SEQ ID NO: 788 - DNA, 28 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (23)..(23): c or methylated C nucleotide
cgggggcgcgcggttcgccccgcgcatg

SEQ ID NO: 789 - DNA, 30 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
gcgggggcgcgcggttcgccccgcgcatgg

SEQ ID NO: 790 - DNA, 20 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (20)..(20): c or methylated C nucleotide
gggggcgcgcggttcgcccc

SEQ ID NO: 791 - DNA, 20 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (18)..(18): c or methylated C nucleotide
ggcgggggcgcgcggttcgc

SEQ ID NO: 792 - DNA, 20 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
gggggcgggggcgcgcggtt

SEQ ID NO: 793 - DNA, 20 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
ggcgggggcgggggcgcgcg

SEQ ID NO: 794 - DNA, 20 bp, Artificial
  synthetic oligonucleotide
  modified_base (18)..(18): c or methylated C nucleotide
  modified_base (20)..(20): c or methylated C nucleotide
cggggcgggggcgggggcgc

SEQ ID NO: 795 - DNA, 20 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
gcgcggttcgccccgcgcat

SEQ ID NO: 796 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (13)..(13): c or methylated C nucleotide
cggttcgccccgcgcatggg

SEQ ID NO: 797 - DNA, 20 bp, Artificial
  synthetic oligonucleotide
  modified_base (3)..(3): c or methylated C nucleotide
  modified_base (8)..(8): c or methylated C nucleotide
  modified_base (10)..(10): c or methylated C nucleotide
ttcgccccgcgcatgggctc

SEQ ID NO: 798 - DNA, 20 bp, Artificial
  synthetic oligonucleotide
  modified_base (5)..(5): c or methylated C nucleotide
  modified_base (7)..(7): c or methylated C nucleotide
gccccgcgcatgggctccgt

SEQ ID NO: 799 - DNA, 20 bp, Artificial
  synthetic oligonucleotide
  modified_base (2)..(2): c or methylated C nucleotide
  modified_base (4)..(4): c or methylated C nucleotide
ccgcgcatgggctccgtccg

SEQ ID NO: 800 - DNA, 18 bp, Artificial
  synthetic oligonucleotide
  modified_base (1)..(1): c or methylated C nucleotide
  modified_base (3)..(3): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (17)..(17): c or methylated C nucleotide
cgcgcggttcgccccgcg

SEQ ID NO: 801 - DNA, 16 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
cgcggttcgccccgcg

SEQ ID NO: 802 - DNA, 15 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
gcggttcgccccgcg

SEQ ID NO: 803 - DNA, 18 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
ggcgcgcggttcgccccg

SEQ ID NO: 804 - DNA, 16 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgccc

SEQ ID NO: 805 - DNA, 15 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
ggcgcgcggttcgcc

SEQ ID NO: 806 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcacggttcgccccgcg

SEQ ID NO: 807 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgtcccgcg

SEQ ID NO: 808 - DNA, 20 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (19)..(19): c or methylated C nucleotide
ggcgcgcggttcgccgcgcg

SEQ ID NO: 809 - DNA, 26 bp, Artificial
  synthetic oligonucleotide
ggcgcgcggttcgccccgcgcatggg

SEQ ID NO: 810 - DNA, 27 bp, Artificial
  synthetic oligonucleotide
gggcgcgcggttcgccccgcgcatggg

SEQ ID NO: 811 - DNA, 28 bp, Artificial
  synthetic oligonucleotide
ggggcgcgcggttcgccccgcgcatggg

SEQ ID NO: 812 - DNA, 29 bp, Artificial
  synthetic oligonucleotide
gggggcgcgcggttcgccccgcgcatggg

SEQ ID NO: 813 - DNA, 30 bp, Artificial; identical to SEQ ID NO: 508
  synthetic oligonucleotide

SEQ ID NO: 814 - DNA, 31 bp, Artificial; identical to SEQ ID NO: 509
  synthetic oligonucleotide

SEQ ID NO: 815 - DNA, 27 bp, Artificial
  synthetic oligonucleotide
ggcgcgcggttcgccccgcgcatgggc

SEQ ID NO: 816 - DNA, 28 bp, Artificial
  synthetic oligonucleotide
ggcgcgcggttcgccccgcgcatgggct

SEQ ID NO: 817 - DNA, 29 bp, Artificial
  synthetic oligonucleotide
ggcgcgcggttcgccccgcgcatgggctc

SEQ ID NO: 818 - DNA, 30 bp, Artificial; identical to SEQ ID NO: 513
  synthetic oligonucleotide

SEQ ID NO: 819 - DNA, 31 bp, Artificial; identical to SEQ ID NO: 514
  synthetic oligonucleotide

SEQ ID NO: 820 - DNA, 28 bp, Artificial
  synthetic oligonucleotide
gggcgcgcggttcgccccgcgcatgggc

SEQ ID NO: 821 - DNA, 30 bp, Artificial; identical to SEQ ID NO: 516
  synthetic oligonucleotide

SEQ ID NO: 822 - DNA, 32 bp, Artificial; identical to SEQ ID NO: 517
  synthetic oligonucleotide

SEQ ID NO: 823 - DNA, 34 bp, Artificial; identical to SEQ ID NO: 518
  synthetic oligonucleotide

SEQ ID NO: 824 - DNA, 36 bp, Artificial; identical to SEQ ID NO: 519
  synthetic oligonucleotide

SEQ ID NO: 825 - DNA, 26 bp, Artificial
  synthetic oligonucleotide
gggggcgcgcggttcgccccgcgcat

SEQ ID NO: 826 - DNA, 26 bp, Artificial
  synthetic oligonucleotide
ggcgggggcgcgcggttcgccccgcg

SEQ ID NO: 827 - DNA, 26 bp, Artificial
  synthetic oligonucleotide
gggggcgggggcgcgcggttcgcccc

SEQ ID NO: 828 - DNA, 26 bp, Artificial
  synthetic oligonucleotide
ggcgggggcgggggcgcgcggttcgc

SEQ ID NO: 829 - DNA, 26 bp, Artificial
  synthetic oligonucleotide
cggggcgggggcgggggcgcgcggtt

SEQ ID NO: 830 - DNA, 26 bp, Artificial
  synthetic oligonucleotide
gcgcggttcgccccgcgcatgggctc

SEQ ID NO: 831 - DNA, 26 bp, Artificial
  synthetic oligonucleotide
cggttcgccccgcgcatgggctccgt

SEQ ID NO: 832 - DNA, 26 bp, Artificial
  synthetic oligonucleotide
ttcgccccgcgcatgggctccgtccg

SEQ ID NO: 833 - DNA, 26 bp, Artificial
  synthetic oligonucleotide
gccccgcgcatgggctccgtccgcgg

SEQ ID NO: 834 - DNA, 26 bp, Artificial
  synthetic oligonucleotide
ccgcgcatgggctccgtccgcgggcc

SEQ ID NO: 835 - DNA, 24 bp, Artificial
  synthetic oligonucleotide
cgcgcggttcgccccgcgcatggg

SEQ ID NO: 836 - DNA, 22 bp, Artificial
  synthetic oligonucleotide
cgcggttcgccccgcgcatggg

SEQ ID NO: 837 - DNA, 20 bp, Artificial
  synthetic oligonucleotide
cggttcgccccgcgcatggg

SEQ ID NO: 838 - DNA, 18 bp, Artificial
  synthetic oligonucleotide
gttcgccccgcgcatggg

SEQ ID NO: 839 - DNA, 16 bp, Artificial
  synthetic oligonucleotide
tcgccccgcgcatggg

SEQ ID NO: 840 - DNA, 15 bp, Artificial
  synthetic oligonucleotide
cgccccgcgcatggg

SEQ ID NO: 841 - DNA, 24 bp, Artificial
  synthetic oligonucleotide
ggcgcgcggttcgccccgcgcatg

SEQ ID NO: 842 - DNA, 22 bp, Artificial
  synthetic oligonucleotide
ggcgcgcggttcgccccgcgca

SEQ ID NO: 843 - DNA, 20 bp, Artificial
  synthetic oligonucleotide
ggcgcgcggttcgccccgcg

SEQ ID NO: 844 - DNA, 18 bp, Artificial
  synthetic oligonucleotide
ggcgcgcggttcgccccg

SEQ ID NO: 845 - DNA, 16 bp, Artificial
  synthetic oligonucleotide
ggcgcgcggttcgccc

SEQ ID NO: 846 - DNA, 15 bp, Artificial
  synthetic oligonucleotide
ggcgcgcggttcgcc

SEQ ID NO: 847 - DNA, 26 bp, Artificial
  synthetic oligonucleotide
ggcgcgctgttcgccccgcgcatggg

SEQ ID NO: 848 - DNA, 26 bp, Artificial
  synthetic oligonucleotide
ggcgcgcggttcgccccgcgcctggg

SEQ ID NO: 849 - DNA, 26 bp, Artificial
  synthetic oligonucleotide
ggcgcgcggttcgacccgcgcatggg

SEQ ID NO: 850 - DNA, 31 bp, Artificial; identical to SEQ ID NO: 474
  synthetic oligonucleotide
  modified_base (3)..(3): c or methylated C nucleotide
  modified_base (7)..(7): c or methylated C nucleotide
  modified_base (19)..(19): c or methylated C nucleotide

SEQ ID NO: 851 - DNA, 32 bp, Artificial
  synthetic oligonucleotide
  modified_base (4)..(4): c or methylated C nucleotide
  modified_base (8)..(8): c or methylated C nucleotide
  modified_base (20)..(20): c or methylated C nucleotide
cagcgtgcgggagggctgtcgcctcgccccca

SEQ ID NO: 852 - DNA, 33 bp, Artificial
  synthetic oligonucleotide
  modified_base (5)..(5): c or methylated C nucleotide
  modified_base (9)..(9): c or methylated C nucleotide
  modified_base (21)..(21): c or methylated C nucleotide
ccagcgtgcgggagggctgtcgcctcgccccca

SEQ ID NO: 853 - DNA, 34 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgccccca

SEQ ID NO: 854 - DNA, 35 bp, Artificial
  synthetic oligonucleotide
  modified_base (7)..(7): c or methylated C nucleotide
  modified_base (11)..(11): c or methylated C nucleotide
  modified_base (23)..(23): c or methylated C nucleotide
acccagcgtgcgggagggctgtcgcctcgccccca

SEQ ID NO: 855 - DNA, 36 bp, Artificial
  synthetic oligonucleotide
  modified_base (8)..(8): c or methylated C nucleotide
  modified_base (12)..(12): c or methylated C nucleotide
  modified_base (24)..(24): c or methylated C nucleotide
aacccagcgtgcgggagggctgtcgcctcgccccca

SEQ ID NO: 856 - DNA, 32 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccac

SEQ ID NO: 857 - DNA, 33 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccact

SEQ ID NO: 858 - DNA, 34 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccactt

SEQ ID NO: 859 - DNA, 35 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccacttg

SEQ ID NO: 860 - DNA, 36 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccccacttgc

SEQ ID NO: 861 - DNA, 33 bp, Artificial
  synthetic oligonucleotide
  modified_base (4)..(4): c or methylated C nucleotide
  modified_base (8)..(8): c or methylated C nucleotide
  modified_base (20)..(20): c or methylated C nucleotide
cagcgtgcgggagggctgtcgcctcgcccccac

SEQ ID NO: 862 - DNA, 35 bp, Artificial
  synthetic oligonucleotide
  modified_base (5)..(5): c or methylated C nucleotide
  modified_base (9)..(9): c or methylated C nucleotide
  modified_base (21)..(21): c or methylated C nucleotide
ccagcgtgcgggagggctgtcgcctcgcccccact

SEQ ID NO: 863 - DNA, 37 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgcccccactt

SEQ ID NO: 864 - DNA, 39 bp, Artificial
  synthetic oligonucleotide
  modified_base (7)..(7): c or methylated C nucleotide
  modified_base (11)..(11): c or methylated C nucleotide
  modified_base (23)..(23): c or methylated C nucleotide
acccagcgtgcgggagggctgtcgcctcgcccccacttg

SEQ ID NO: 865 - DNA, 41 bp, Artificial
  synthetic oligonucleotide
  modified_base (8)..(8): c or methylated C nucleotide
  modified_base (12)..(12): c or methylated C nucleotide
  modified_base (24)..(24): c or methylated C nucleotide
aacccagcgtgcgggagggctgtcgcctcgcccccacttgc

SEQ ID NO: 866 - DNA, 31 bp, Artificial
  synthetic oligonucleotide
  modified_base (6)..(6): c or methylated C nucleotide
  modified_base (10)..(10): c or methylated C nucleotide
  modified_base (22)..(22): c or methylated C nucleotide
cccagcgtgcgggagggctgtcgcctcgccc

SEQ ID NO: 867 - DNA, 31 bp, Artificial
  synthetic oligonucleotide
  modified_base (9)..(9): c or methylated C nucleotide
  modified_base (13)..(13): c or methylated C nucleotide
  modified_base (25)..(25): c or methylated C nucleotide
caacccagcgtgcgggagggctgtcgcctcg

SEQ ID NO: 868 - DNA, 31 bp, Artificial
  synthetic oligonucleotide
  modified_base (12)..(12): c or methylated C nucleotide
  modified_base (16)..(16): c or methylated C nucleotide
  modified_base (28)..(28): c or methylated C nucleotide
ctgcaacccagcgtgcgggagggctgtcgcc

SEQ ID NO: 869 - DNA, 31 bp, Artificial
  synthetic oligonucleotide
  modified_base (15)..(15): c or methylated C nucleotide
  modified_base (19)..(19): c or methylated C nucleotide
  modified_base (31)..(31): c or methylated C nucleotide
cagctgcaacccagcgtgcgggagggctgtc

SEQ ID NO: 870 - DNA, 31 bp, Artificial
  synthetic oligonucleotide
  modified_base (18)..(18): c or methylated C nucleotide
  modified_base (22)..(22): c or methylated C nucleotide
gtgcagctgcaacccagcgtgcgggagggct

SEQ ID NO: 871 - DNA, 31 bp, Artificial
  synthetic oligonucleotide
  modified_base (4)..(4): c or methylated C nucleotide
  modified_base (16)..(16): c or methylated C nucleotide
gtgcgggagggctgtcgcctcgcccccactt

SEQ ID NO: 872 - DNA, 31 bp, Artificial
  synthetic oligonucleotide
  modified_base (1)..(1): c or methylated C nucleotide
  modified_base (13)..(13): c or methylated C nucleotide
cgggagggctgtcgcctcgcccccacttgct

SEQ ID NO: 873 - DNA, 31 bp, Artificial
  synthetic oligonucleotide
  modified_base (10)..(10): c or methylated C nucleotide
gagggctgtcgcctcgcccccacttgctctt

SEQ ID NO: 874 - DNA, 31 bp, Artificial
  synthetic oligonucleotide
  modified_base (7)..(7): c or methylated C nucleotide
ggctgtcgcctcgcccccacttgctcttaat

SEQ ID NO: 875 - DNA, 31 bp, Artificial
  synthetic oligonucleotide
  modified_base (4)..(4): c or methylated C nucleotide
tgtcgcctcgcccccacttgctcttaatgac

SEQ ID NO: 876 - DNA, 29 bp, Artificial
  synthetic oligonucleotide
  modified_base (1)..(1): c or methylated C nucleotide
  modified_base (5)..(5): c or methylated C nucleotide
  modified_base (17)..(17): c or methylated C nucleotide
cgtgcgggagggctgtcgcctcgccccca

SEQ ID NO: 877 - DNA, 27 bp, Artificial
  synthetic oligonucleotide
  modified_base (3)..(3): c or methylated C nucleotide
  modified_base (15)..(15): c or methylated C nucleotide
tgcgggagggctgtcgcctcgccccca

SEQ ID NO: 878 - DNA, 25 bp, Artificial
  synthetic oligonucleotide
  modified_base (1)..(1): c or methylated C nucleotide
  modified_base (13)..(13): c or methylated C nucleotide
cgggagggctgtcgcctcgccccca

SEQ ID NO: 879 - DNA, 23 bp, Artificial
  synthetic oligonucleotide
  modified_base (11)..(11): c or methylated C nucleotide
ggagggctgtcgcctcgccccca

SEQ ID NO: 880 - DNA, 21 bp, Artificial
  synthetic oligonucleotide
  modified_base (9)..(9): c or methylated C nucleotide
agggctgtcgcctcgccccca

SEQ ID NO: 881 - DNA, 19 bp, Artificial
  synthetic oligonucleotide
  modified_base (7)..(7): c or methylated C nucleotide
ggctgtcgcctcgccccca

SEQ ID NO: 882 - DNA, 17 bp, Artificial
  synthetic oligonucleotide
  modified_base (5)..(5): c or methylated C nucleotide
ctgtcgcctcgccccca

SEQ ID NO: 883 - DNA, 15 bp, Artificial
  synthetic oligonucleotide
  modified_base (3)..(3): c or methylated C nucleotide
gtcgcctcgccccca

SEQ ID NO: 884 - DNA, 29 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcccc

SEQ ID NO: 885 - DNA, 27 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcgcc

SEQ ID NO: 886 - DNA, 25 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcctcg

SEQ ID NO: 887 - DNA, 23 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcct

SEQ ID NO: 888 - DNA, 21 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgc

SEQ ID NO: 889 - DNA, 19 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtc

SEQ ID NO: 890 - DNA, 17 bp, Artificial
  synthetic oligonucleotide
  modified_base (3)..(3): c or methylated C nucleotide
  modified_base (7)..(7): c or methylated C nucleotide
agcgtgcgggagggctg

SEQ ID NO: 891 - DNA, 15 bp, Artificial
  synthetic oligonucleotide
  modified_base (3)..(3): c or methylated C nucleotide
  modified_base (7)..(7): c or methylated C nucleotide
agcgtgcgggagggc

SEQ ID NO: 892 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgagcgggagggctgtcgcctcgccccca

SEQ ID NO: 893 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggatgtcgcctcgccccca

SEQ ID NO: 894 - DNA, 31 bp, Artificial
  synthetic oligonucleotide
  modified_base (3)..(3): c or methylated C nucleotide
  modified_base (7)..(7): c or methylated C nucleotide
  modified_base (19)..(19): c or methylated C nucleotide
agcgtgcgggagggctgtcgcgtcgccccca

SEQ ID NO: 895 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggca

SEQ ID NO: 896 - DNA, 27 bp, Artificial
  synthetic oligonucleotide
  modified_base (3)..(3): c or methylated C nucleotide
  modified_base (8)..(8): c or methylated C nucleotide
  modified_base (15)..(15): c or methylated C nucleotide
  modified_base (19)..(19): c or methylated C nucleotide
tgcggctcgggttgcgggcgcagggca

SEQ ID NO: 897 - DNA, 28 bp, Artificial
  synthetic oligonucleotide
  modified_base (4)..(4): c or methylated C nucleotide
  modified_base (9)..(9): c or methylated C nucleotide
  modified_base (16)..(16): c or methylated C nucleotide
  modified_base (20)..(20): c or methylated C nucleotide
gtgcggctcgggttgcgggcgcagggca

SEQ ID NO: 898 - DNA, 29 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagggca

SEQ ID NO: 899 - DNA, 30 bp, Artificial
  synthetic oligonucleotide
  modified_base (6)..(6): c or methylated C nucleotide
  modified_base (11)..(11): c or methylated C nucleotide
  modified_base (18)..(18): c or methylated C nucleotide
  modified_base (22)..(22): c or methylated C nucleotide
gggtgcggctcgggttgcgggcgcagggca

SEQ ID NO: 900 - DNA, 31 bp, Artificial
  synthetic oligonucleotide
  modified_base (7)..(7): c or methylated C nucleotide
  modified_base (12)..(12): c or methylated C nucleotide
  modified_base (19)..(19): c or methylated C nucleotide
  modified_base (23)..(23): c or methylated C nucleotide
cgggtgcggctcgggttgcgggcgcagggca

SEQ ID NO: 901 - DNA, 27 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcac

SEQ ID NO: 902 - DNA, 28 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacg

SEQ ID NO: 903 - DNA, 29 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacgg

SEQ ID NO: 904 - DNA, 30 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacggg

SEQ ID NO: 905 - DNA, 31 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcagggcacgggc

SEQ ID NO: 906 - DNA, 28 bp, Artificial
  synthetic oligonucleotide
  modified_base (3)..(3): c or methylated C nucleotide
  modified_base (8)..(8): c or methylated C nucleotide
  modified_base (15)..(15): c or methylated C nucleotide
  modified_base (19)..(19): c or methylated C nucleotide
tgcggctcgggttgcgggcgcagggcac

SEQ ID NO: 907 - DNA, 30 bp, Artificial
  synthetic oligonucleotide
  modified_base (4)..(4): c or methylated C nucleotide
  modified_base (9)..(9): c or methylated C nucleotide
  modified_base (16)..(16): c or methylated C nucleotide
  modified_base (20)..(20): c or methylated C nucleotide
gtgcggctcgggttgcgggcgcagggcacg

SEQ ID NO: 908 - DNA, 32 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagggcacgg

SEQ ID NO: 909 - DNA, 34 bp, Artificial
  synthetic oligonucleotide
  modified_base (6)..(6): c or methylated C nucleotide
  modified_base (11)..(11): c or methylated C nucleotide
  modified_base (18)..(18): c or methylated C nucleotide
  modified_base (22)..(22): c or methylated C nucleotide
gggtgcggctcgggttgcgggcgcagggcacggg

SEQ ID NO: 910 - DNA, 36 bp, Artificial
  synthetic oligonucleotide
  modified_base (7)..(7): c or methylated C nucleotide
  modified_base (12)..(12): c or methylated C nucleotide
  modified_base (19)..(19): c or methylated C nucleotide
  modified_base (23)..(23): c or methylated C nucleotide
cgggtgcggctcgggttgcgggcgcagggcacgggc

SEQ ID NO: 911 - DNA, 26 bp, Artificial
  synthetic oligonucleotide
  modified_base (5)..(5): c or methylated C nucleotide
  modified_base (10)..(10): c or methylated C nucleotide
  modified_base (17)..(17): c or methylated C nucleotide
  modified_base (21)..(21): c or methylated C nucleotide
ggtgcggctcgggttgcgggcgcagg

SEQ ID NO: 912 - DNA, 26 bp, Artificial
  synthetic oligonucleotide
  modified_base (8)..(8): c or methylated C nucleotide
  modified_base (13)..(13): c or methylated C nucleotide
  modified_base (20)..(20): c or methylated C nucleotide
  modified_base (24)..(24): c or methylated C nucleotide
gcgggtgcggctcgggttgcgggcgc

SEQ ID NO: 913 - DNA, 26 bp, Artificial
  synthetic oligonucleotide
  modified_base (11)..(11): c or methylated C nucleotide
  modified_base (16)..(16): c or methylated C nucleotide
  modified_base (23)..(23): c or methylated C nucleotide
gcggcgggtgcggctcgggttgcggg

SEQ ID NO: 914 - DNA, 26 bp, Artificial
  synthetic oligonucleotide
  modified_base (14)..(14): c or methylated C nucleotide
  modified_base (19)..(19): c or methylated C nucleotide
  modified_base (26)..(26): c or methylated C nucleotide
tccgcggcgggtgcggctcgggttgc

SEQ ID NO: 915 - DNA, 26 bp, Artificial
  synthetic oligonucleotide
  modified_base (17)..(17): c or methylated C nucleotide
  modified_base (22)..(22): c or methylated C nucleotide
ccgtccgcggcgggtgcggctcgggt

SEQ ID NO: 916 - DNA, 26 bp, Artificial
  synthetic oligonucleotide
  modified_base (4)..(4): c or methylated C nucleotide
  modified_base (11)..(11): c or methylated C nucleotide
  modified_base (15)..(15): c or methylated C nucleotide
gctcgggttgcgggcgcagggcacgg

SEQ ID NO: 917 - DNA, 26 bp, Artificial
  synthetic oligonucleotide
  modified_base (1)..(1): c or methylated C nucleotide
  modified_base (8)..(8): c or methylated C nucleotide
  modified_base (12)..(12): c or methylated C nucleotide
cgggttgcgggcgcagggcacgggcg

SEQ ID NO: 918 - DNA, 26 bp, Artificial
  synthetic oligonucleotide
  modified_base (5)..(5): c or methylated C nucleotide
  modified_base (9)..(9): c or methylated C nucleotide
gttgcgggcgcagggcacgggcggcg

SEQ ID NO: 919 - DNA, 26 bp, Artificial
  synthetic oligonucleotide
  modified_base (2)..(2): c or methylated C nucleotide
  modified_base (6)..(6): c or methylated C nucleotide
gcgggcgcagggcacgggcggcggag

SEQ ID NO: 920 - DNA, 26 bp, Artificial
  synthetic oligonucleotide
  modified_base (3)..(3): c or methylated C nucleotide
ggcgcagggcacgggcggcggagact

SEQ ID NO: 921 - DNA, 24 bp, Artificial
  synthetic oligonucleotide
  modified_base (5)..(5): c or methylated C nucleotide
  modified_base (12)..(12): c or methylated C nucleotide
  modified_base (16)..(16): c or methylated C nucleotide
ggctcgggttgcgggcgcagggca

SEQ ID NO: 922 - DNA, 22 bp, Artificial
  synthetic oligonucleotide
  modified_base (3)..(3): c or methylated C nucleotide
  modified_base (10)..(10): c or methylated C nucleotide
  modified_base (14)..(14): c or methylated C nucleotide
ctcgggttgcgggcgcagggca

SEQ ID NO: 923 - DNA, 20 bp, Artificial
  synthetic oligonucleotide
  modified_base (1)..(1): c or methylated C nucleotide
  modified_base (8)..(8): c or methylated C nucleotide
  modified_base (12)..(12): c or methylated C nucleotide
cgggttgcgggcgcagggca

SEQ ID NO: 924 - DNA, 18 bp, Artificial
  synthetic oligonucleotide
  modified_base (6)..(6): c or methylated C nucleotide
  modified_base (10)..(10): c or methylated C nucleotide
ggttgcgggcgcagggca

SEQ ID NO: 925 - DNA, 16 bp, Artificial
  synthetic oligonucleotide
  modified_base (4)..(4): c or methylated C nucleotide
  modified_base (8)..(8): c or methylated C nucleotide
ttgcgggcgcagggca

SEQ ID NO: 926 - DNA, 15 bp, Artificial
  synthetic oligonucleotide
  modified_base (3)..(3): c or methylated C nucleotide
  modified_base (7)..(7): c or methylated C nucleotide
tgcgggcgcagggca

SEQ ID NO: 927 - DNA, 24 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcaggg

SEQ ID NO: 928 - DNA, 22 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgcag

SEQ ID NO: 929 - DNA, 20 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggcgc

SEQ ID NO: 930 - DNA, 18 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcgggc

SEQ ID NO: 931 - DNA, 16 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
gcggctcgggttgcgg

SEQ ID NO: 932 - DNA, 15 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
gcggctcgggttgcg

SEQ ID NO: 933 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcgactcgggttgcgggcgcagggca

SEQ ID NO: 934 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttgcggtcgcagggca

SEQ ID NO: 935 - DNA, 26 bp, Artificial
  synthetic oligonucleotide
  modified_base (2)..(2): c or methylated C nucleotide
  modified_base (7)..(7): c or methylated C nucleotide
  modified_base (14)..(14): c or methylated C nucleotide
  modified_base (18)..(18): c or methylated C nucleotide
gcggctcgggttccgggcgcagggca

SEQ ID NO: 936 - DNA, 2824 bp, Homo sapiens
ctatcattcctccctatctacactaacatcccacgctctgaacgcgcgcccattaatacccttctttcctccactctccctgggactcttgatcaaagcgcggccctttccccagccttagcgaggcgccctgcagcctggtacgcgcgtggcgtggcggtgggcgcgcagtgcgttctcggtgtggagggcagctgttccgcctgcgatgatttatactcacaggacaaggatgcggtttgtcaaacagtactgctacggaggagcagcagagaaagggagagggtttgagagggagcaaaagaaaatggtaggcgcgcgtagttaattcatgcggctctcttactctgtttacatcctagagctagagtgctcggctgcccggctgagtctcctccccaccttccccaccctccccaccctccccataagcgcccctcccgggttcccaaagcagagggcgtgggggaaaagaaaaaagatcctctctcgctaatctccgcccaccggccctttataatgcgagggtctggacggctgaggacccccgagctgtgctgctcgcggccgccaccgccgggccccggccgtccctggctcccctcctgcctcgagaagggcagggcttctcagaggcttggcgggaaaaagaacggagggagggatcgcgctgagtataaaagccggttttcggggctttatctaactcgctgtagtaattccagcgagaggcagagggagcgagcgggcggccggctagggtggaagagccgggcgagcagagctgcgctgcgggcgtcctgggaagggagatccggagcgaatagggggcttcgcctctggcccagccctcccgctgatcccccagccagcggtccgcaacccttgccgcatccacgaaactttgcccatagcagcgggcgggcactttgcactggaacttacaacacccgagcaaggacgcgactctcccgacgcggggaggctattctgcccatttggggacacttccccgccgctgccaggacccgcttctctgaaaggctctccttgcagctgcttagacgctggatttttttcgggtagtggaaaaccaggtaagcaccgaagtccacttgccttttaatttatttttttatcactttaatgctgagatgagtcgaatgcctaaatagggtgtcttttctcccattcctgcgctattgacacttttctcagagtagttatggtaactggggctggggtggggggtaatccagaactggatcggggtaaagtgacttgtcaagatgggagaggagaaggcagagggaaaacgggaatggtttttaagactaccctttcgagatttctgccttatgaatatattcacgctgactcccggccggtcggacattcctgctttattgtgttaattgctctctgggttttggggggctgggggttgctttgcggtgggcagaaagccccttgcatcctgagctccttggagtagggaccgcatatcgcctgtgtgagccagatcgctccgcagccgctgacttgtccccgtctccgggagggcatttaaatttcggctcaccgcatttctgacagccggagacggacactgcggcgcgtcccgcccgcctgtccccgcggcgattccaacccgccctgatccttttaagaagttggcatttggctttttaaaaagcaataatacaatttaaaacctgggtctctagaggtgttaggacgtggtgttgggtaggcgcaggcaggggaaaagggaggcgaggatgtgtccgattctcctggaatcgttgacttggaaaaaccagggcgaatctccgcacccagccctgactcccctgccgcggccgccctcgggtgtcctcgcgcccgagatgcggaggaactgcgaggagcggggctctgggcggttccagaacagctgctacccttggtggggtggctccgggggaggtatcgcagcggggtctctggcgcagttgcatctccgtattgagtgcgaagggaggtgcccctattattatttgacaccccccttgtatttatggaggggtgttaaagcccgcggctgagctcgccactccagccggcgagagaaagaagaaaagctggcaaaaggagtgttggacgggggcggtactgggggtggggacgggggcggtggagagggaaggttgggaggggctgcggtgccggcgggggtaggagagcggctagggcgcgagtgggaacagccgcagcggaggggccccggcgcggagcggggttcacgcagccgctagcgcccaggcgcctctcgccttctccttcaggtggcgcaaaactttgtgccttggattttggcaaattgttttcctcaccgccacctcccgcggcttcttaagggcgccagggccgatttcgattcctctgccgctgcggggccgactcccgggctttgcgctccgggctcccgggggagcgggggctcggcgggcaccaagccgctggttcactaagtgcgtctccgagatagcaggggactgtccaaagggggtgaaagggtgctccctttattcccccaccaagaccacccagccgctttaggggatagctctgcaaggggagaggttcgggactgtggcgcgcactgcgcgctgcgccaggtttccgcaccaagacccctttaactcaagactgcctcccgctttgtgtgccccgctccagcagcctcccgcgacgatgcccctcaacgttagcttcaccaacaggaactatgacctcgactacgactcggtgcagccgtatttctactgcgacgaggaggaga

SEQ ID NO: 937 - DNA, 27 bp, Artificial
  synthetic oligonucleotide
  modified_base (1)..(1): c or methylated C nucleotide
  modified_base (5)..(5): c or methylated C nucleotide
  modified_base (12)..(12): c or methylated C nucleotide
  modified_base (14)..(14): c or methylated C nucleotide
  modified_base (20)..(20): c or methylated C nucleotide
  modified_base (24)..(24): c or methylated C nucleotide
  modified_base (26)..(26): c or methylated C nucleotide
cggccggggcccgcggtggcggccgcg

SEQ ID NO: 938 - DNA, 25 bp, Artificial
  synthetic oligonucleotide
  modified_base (3)..(3): c or methylated C nucleotide
  modified_base (18)..(18): c or methylated C nucleotide
  modified_base (20)..(20): c or methylated C nucleotide
  modified_base (22)..(22): c or methylated C nucleotide
gccgcatgaattaactacgcgcgcc

SEQ ID NO: 939 - DNA, 25 bp, Artificial
  synthetic oligonucleotide
  modified_base (3)..(3): c or methylated C nucleotide
  modified_base (10)..(10): c or methylated C nucleotide
  modified_base (22)..(22): c or methylated C nucleotide
gccggtgggcggagagattagcgag

SEQ ID NO: 940 - DNA, 29 bp, Artificial
  synthetic oligonucleotide
  modified_base (3)..(3): c or methylated C nucleotide
  modified_base (16)..(16): c or methylated C nucleotide
  modified_base (28)..(28): c or methylated C nucleotide
agcgatccctccctccgttctttttcccg

SEQ ID NO: 941 - DNA, 31 bp, Artificial
  synthetic oligonucleotide
  modified_base (2)..(2): c or methylated C nucleotide
  modified_base (29)..(29): c or methylated C nucleotide
tcgcagggggaacagctgccctccacaccga

SEQ ID NO: 942 - DNA, 27 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (21)..(21): c or methylated C nucleotide
  modified_base (23)..(23): c or methylated C nucleotide
  modified_base (25)..(25): c or methylated C nucleotide
tgcgcgcccaccgccagccacgcgcgt

SEQ ID NO: 943 - DNA, 34 bp, Artificial
  synthetic oligonucleotide
  modified_base (4)..(4): c or methylated C nucleotide
  modified_base (9)..(9): c or methylated C nucleotide
  modified_base (30)..(30): c or methylated C nucleotide
  modified_base (32)..(32): c or methylated C nucleotide
gggcgcctcgctaaggctggggaaagggccgcgc

SEQ ID NO: 944 - DNA, 30 bp, Artificial
  synthetic oligonucleotide
ctactcctcgtagtgtttgacaaatcgcat

SEQ ID NO: 945 - DNA, 27 bp, Artificial
  synthetic oligonucleotide
ctcagccgggcagccgagcactctacc

SEQ ID NO: 946 - DNA, 34 bp, Artificial
  synthetic oligonucleotide
ccacgccctctgctttgggaacccgggagggcgc

SEQ ID NO: 947 - DNA, 28 bp, Artificial
  synthetic oligonucleotide
cgagttagataaagccccgaaaatcggc

SEQ ID NO: 948 - DNA, 33 bp, Artificial
  synthetic oligonucleotide
cggctcttccaccctaggcggccgcccgctcgc

SEQ ID NO: 949 - DNA, 24 bp, Artificial
  synthetic oligonucleotide
ggcgaagcccccgattcgctccgg

SEQ ID NO: 950 - DNA, 37 bp, Artificial
  synthetic oligonucleotide
  misc_feature (12)..(12): n is a, c, g, or t
gtctcctcgcgntcgggagactcgcgtccttgctcgg

SEQ ID NO: 951 - DNA, 36 bp, Artificial
  synthetic oligonucleotide
gccgcgggaggtggcggtgaggaatacaatttcccg

SEQ ID NO: 952 - DNA, 36 bp, Artificial
  synthetic oligonucleotide
cgtcggccccgcagcggcagaggaatcgaaagcggc

SEQ ID NO: 953 - DNA, 30 bp, Artificial
  synthetic oligonucleotide
cttggtgcggaaacctggcgcagcgcgcag

SEQ ID NO: 954 - DNA, 25 bp, Artificial
  synthetic oligonucleotide
cagcacagctcgggggtcctcagcc

SEQ ID NO: 955 - DNA, 28 bp, Artificial
  synthetic oligonucleotide
cgtgaatgcggcaaggattgcggaccac

SEQ ID NO: 956 - DNA, 20 bp, Artificial
  synthetic oligonucleotide
gtgaccgccccgtgttatgg

SEQ ID NO: 957 - DNA, 22 bp, Artificial
  synthetic oligonucleotide
gtcgatggcgcaggagtgggag

SEQ ID NO: 958 - DNA, 31 bp, Artificial
  synthetic oligonucleotide
ctgctggagcggggcacacaaagcgggaggc

SEQ ID NO: 959 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcc

SEQ ID NO: 960 - DNA, 27 bp, Artificial
  synthetic oligonucleotide
  modified_base (4)..(4): c or methylated C nucleotide
  modified_base (20)..(20): c or methylated C nucleotide
  modified_base (22)..(22): c or methylated C nucleotide
  modified_base (24)..(24): c or methylated C nucleotide
agccgcattgaattaactacgcgcgcc

SEQ ID NO: 961 - DNA, 28 bp, Artificial
  synthetic oligonucleotide
  modified_base (5)..(5): c or methylated C nucleotide
  modified_base (21)..(21): c or methylated C nucleotide
  modified_base (23)..(23): c or methylated C nucleotide
  modified_base (25)..(25): c or methylated C nucleotide
gagccgcattgaattaactacgcgcgcc

SEQ ID NO: 962 - DNA, 29 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgcgcc

SEQ ID NO: 963 - DNA, 30 bp, Artificial
  synthetic oligonucleotide
  modified_base (7)..(7): c or methylated C nucleotide
  modified_base (23)..(23): c or methylated C nucleotide
  modified_base (25)..(25): c or methylated C nucleotide
  modified_base (27)..(27): c or methylated C nucleotide
gagagccgcattgaattaactacgcgcgcc

SEQ ID NO: 964 - DNA, 31 bp, Artificial
  synthetic oligonucleotide
  modified_base (8)..(8): c or methylated C nucleotide
  modified_base (24)..(24): c or methylated C nucleotide
  modified_base (26)..(26): c or methylated C nucleotide
  modified_base (28)..(28): c or methylated C nucleotide
agagagccgcattgaattaactacgcgcgcc

SEQ ID NO: 965 - DNA, 27 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcct

SEQ ID NO: 966 - DNA, 28 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgccta

SEQ ID NO: 967 - DNA, 29 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctac

SEQ ID NO: 968 - DNA, 30 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctacc

SEQ ID NO: 969 - DNA, 31 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcgcctacca

SEQ ID NO: 970 - DNA, 28 bp, Artificial
  synthetic oligonucleotide
  modified_base (4)..(4): c or methylated C nucleotide
  modified_base (20)..(20): c or methylated C nucleotide
  modified_base (22)..(22): c or methylated C nucleotide
  modified_base (24)..(24): c or methylated C nucleotide
agccgcattgaattaactacgcgcgcct

SEQ ID NO: 971 - DNA, 30 bp, Artificial
  synthetic oligonucleotide
  modified_base (5)..(5): c or methylated C nucleotide
  modified_base (21)..(21): c or methylated C nucleotide
  modified_base (23)..(23): c or methylated C nucleotide
  modified_base (25)..(25): c or methylated C nucleotide
gagccgcattgaattaactacgcgcgccta

SEQ ID NO: 972 - DNA, 32 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgcgcctac

SEQ ID NO: 973 - DNA, 34 bp, Artificial
  synthetic oligonucleotide
  modified_base (7)..(7): c or methylated C nucleotide
  modified_base (23)..(23): c or methylated C nucleotide
  modified_base (25)..(25): c or methylated C nucleotide
  modified_base (27)..(27): c or methylated C nucleotide
gagagccgcattgaattaactacgcgcgcctacc

SEQ ID NO: 974 - DNA, 36 bp, Artificial
  synthetic oligonucleotide
  modified_base (8)..(8): c or methylated C nucleotide
  modified_base (24)..(24): c or methylated C nucleotide
  modified_base (26)..(26): c or methylated C nucleotide
  modified_base (28)..(28): c or methylated C nucleotide
agagagccgcattgaattaactacgcgcgcctacca

SEQ ID NO: 975 - DNA, 26 bp, Artificial
  synthetic oligonucleotide
  modified_base (6)..(6): c or methylated C nucleotide
  modified_base (22)..(22): c or methylated C nucleotide
  modified_base (24)..(24): c or methylated C nucleotide
  modified_base (26)..(26): c or methylated C nucleotide
agagccgcattgaattaactacgcgc

SEQ ID NO: 976 - DNA, 26 bp, Artificial
  synthetic oligonucleotide
  modified_base (9)..(9): c or methylated C nucleotide
  modified_base (25)..(25): c or methylated C nucleotide
aagagagccgcattgaattaactacg

SEQ ID NO: 977 - DNA, 26 bp, Artificial
  synthetic oligonucleotide
  modified_base (12)..(12): c or methylated C nucleotide
agtaagagagccgcattgaattaact

SEQ ID NO: 978 - DNA, 26 bp, Artificial
  synthetic oligonucleotide
  modified_base (15)..(15): c or methylated C nucleotide
cagagtaagagagccgcattgaatta

SEQ ID NO: 979 - DNA, 26 bp, Artificial
  synthetic oligonucleotide
  modified_base (18)..(18): c or methylated C nucleotide
aaacagagtaagagagccgcattgaa

SEQ ID NO: 980 - DNA, 26 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
gcattgaattaactacgcgcgcctac

SEQ ID NO: 981 - DNA, 26 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
ttgaattaactacgcgcgcctaccat

SEQ ID NO: 982 - DNA, 26 bp, Artificial
  synthetic oligonucleotide
  modified_base (10)..(10): c or methylated C nucleotide
  modified_base (12)..(12): c or methylated C nucleotide
  modified_base (14)..(14): c or methylated C nucleotide
aattaactacgcgcgcctaccatttt

SEQ ID NO: 983 - DNA, 26 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
taactacgcgcgcctaccattttctt

SEQ ID NO: 984 - DNA, 26 bp, Artificial
  synthetic oligonucleotide
  modified_base (4)..(4): c or methylated C nucleotide
  modified_base (6)..(6): c or methylated C nucleotide
  modified_base (8)..(8): c or methylated C nucleotide
ctacgcgcgcctaccattttcttttg

SEQ ID NO: 985 - DNA, 24 bp, Artificial
  synthetic oligonucleotide
  modified_base (1)..(1): c or methylated C nucleotide
  modified_base (17)..(17): c or methylated C nucleotide
  modified_base (19)..(19): c or methylated C nucleotide
  modified_base (21)..(21): c or methylated C nucleotide
cgcattgaattaactacgcgcgcc

SEQ ID NO: 986 - DNA, 22 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
cattgaattaactacgcgcgcc

SEQ ID NO: 987 - DNA, 20 bp, Artificial
  synthetic oligonucleotide
  modified_base (13)..(13): c or methylated C nucleotide
  modified_base (15)..(15): c or methylated C nucleotide
  modified_base (17)..(17): c or methylated C nucleotide
ttgaattaactacgcgcgcc

SEQ ID NO: 988 - DNA, 18 bp, Artificial
  synthetic oligonucleotide
  modified_base (11)..(11): c or methylated C nucleotide
  modified_base (13)..(13): c or methylated C nucleotide
  modified_base (15)..(15): c or methylated C nucleotide
gaattaactacgcgcgcc

SEQ ID NO: 989 - DNA, 16 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
attaactacgcgcgcc

SEQ ID NO: 990 - DNA, 15 bp, Artificial
  synthetic oligonucleotide
  modified_base (8)..(8): c or methylated C nucleotide
  modified_base (10)..(10): c or methylated C nucleotide
  modified_base (12)..(12): c or methylated C nucleotide
ttaactacgcgcgcc

SEQ ID NO: 991 - DNA, 24 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattaactacgcgcg

SEQ ID NO: 992 - DNA, 22 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
gccgcattgaattaactacgcg

SEQ ID NO: 993 - DNA, 20 bp, Artificial
  synthetic oligonucleotide
  modified_base (3)..(3): c or methylated C nucleotide
  modified_base (19)..(19): c or methylated C nucleotide
gccgcattgaattaactacg

SEQ ID NO: 994 - DNA, 18 bp, Artificial
  synthetic oligonucleotide
  modified_base (3)..(3): c or methylated C nucleotide
gccgcattgaattaacta

SEQ ID NO: 995 - DNA, 16 bp, Artificial
  synthetic oligonucleotide
  modified_base (3)..(3): c or methylated C nucleotide
gccgcattgaattaac

SEQ ID NO: 996 - DNA, 15 bp, Artificial
  synthetic oligonucleotide
  modified_base (3)..(3): c or methylated C nucleotide
gccgcattgaattaa

SEQ ID NO: 997 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgaattcactacgcgcgcc

SEQ ID NO: 998 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcatcgaattaactacgcgcgcc

SEQ ID NO: 999 - DNA, 26 bp, Artificial
  synthetic oligonucleotide
  modified_base (3)..(3): c or methylated C nucleotide
  modified_base (19)..(19): c or methylated C nucleotide
  modified_base (21)..(21): c or methylated C nucleotide
  modified_base (23)..(23): c or methylated C nucleotide
gccgcattgagttaactacgcgcgcc

SEQ ID NO: 1000 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgag

SEQ ID NO: 1001 - DNA, 25 bp, Artificial
  synthetic oligonucleotide
  modified_base (4)..(4): c or methylated C nucleotide
  modified_base (11)..(11): c or methylated C nucleotide
  modified_base (22)..(22): c or methylated C nucleotide
ggccggtgggcggagagttagcgag

SEQ ID NO: 1002 - DNA, 26 bp, Artificial
  synthetic oligonucleotide
  modified_base (5)..(5): c or methylated C nucleotide
  modified_base (12)..(12): c or methylated C nucleotide
  modified_base (23)..(23): c or methylated C nucleotide
gggccggtgggcggagagttagcgag

SEQ ID NO: 1003 - DNA, 27 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagcgag

SEQ ID NO: 1004 - DNA, 28 bp, Artificial
  synthetic oligonucleotide
  modified_base (7)..(7): c or methylated C nucleotide
  modified_base (14)..(14): c or methylated C nucleotide
  modified_base (25)..(25): c or methylated C nucleotide
aagggccggtgggcggagagttagcgag

SEQ ID NO: 1005 - DNA, 29 bp, Artificial
  synthetic oligonucleotide
  modified_base (8)..(8): c or methylated C nucleotide
  modified_base (15)..(15): c or methylated C nucleotide
  modified_base (26)..(26): c or methylated C nucleotide
aaagggccggtgggcggagagttagcgag

SEQ ID NO: 1006 - DNA, 25 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgaga

SEQ ID NO: 1007 - DNA, 26 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagag

SEQ ID NO: 1008 - DNA, 27 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagaga

SEQ ID NO: 1009 - DNA, 28 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagagag

SEQ ID NO: 1010 - DNA, 29 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcgagagagg

SEQ ID NO: 1011 - DNA, 26 bp, Artificial
  synthetic oligonucleotide
  modified_base (4)..(4): c or methylated C nucleotide
  modified_base (11)..(11): c or methylated C nucleotide
  modified_base (22)..(22): c or methylated C nucleotide
ggccggtgggcggagagttagcgaga

SEQ ID NO: 1012 - DNA, 28 bp, Artificial
  synthetic oligonucleotide
  modified_base (5)..(5): c or methylated C nucleotide
  modified_base (12)..(12): c or methylated C nucleotide
  modified_base (23)..(23): c or methylated C nucleotide
gggccggtgggcggagagttagcgagag

SEQ ID NO: 1013 - DNA, 30 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagcgagaga

SEQ ID NO: 1014 - DNA, 32 bp, Artificial
  synthetic oligonucleotide
  modified_base (7)..(7): c or methylated C nucleotide
  modified_base (14)..(14): c or methylated C nucleotide
  modified_base (25)..(25): c or methylated C nucleotide
aagggccggtgggcggagagttagcgagagag

SEQ ID NO: 1015 - DNA, 34 bp, Artificial
  synthetic oligonucleotide
  modified_base (8)..(8): c or methylated C nucleotide
  modified_base (15)..(15): c or methylated C nucleotide
  modified_base (26)..(26): c or methylated C nucleotide
aaagggccggtgggcggagagttagcgagagagg

SEQ ID NO: 1016 - DNA, 24 bp, Artificial
  synthetic oligonucleotide
  modified_base (6)..(6): c or methylated C nucleotide
  modified_base (13)..(13): c or methylated C nucleotide
  modified_base (24)..(24): c or methylated C nucleotide
agggccggtgggcggagagttagc

SEQ ID NO: 1017 - DNA, 24 bp, Artificial
  synthetic oligonucleotide
  modified_base (9)..(9): c or methylated C nucleotide
  modified_base (16)..(16): c or methylated C nucleotide
taaagggccggtgggcggagagtt

SEQ ID NO: 1018 - DNA, 25 bp, Artificial
  synthetic oligonucleotide
  modified_base (12)..(12): c or methylated C nucleotide
  modified_base (19)..(19): c or methylated C nucleotide
ttataaagggccggtgggcggagag

SEQ ID NO: 1019 - DNA, 25 bp, Artificial
  synthetic oligonucleotide
  modified_base (15)..(15): c or methylated C nucleotide
  modified_base (22)..(22): c or methylated C nucleotide
gcattataaagggccggtgggcgga

SEQ ID NO: 1020 - DNA, 25 bp, Artificial
  synthetic oligonucleotide
  modified_base (18)..(18): c or methylated C nucleotide
  modified_base (25)..(25): c or methylated C nucleotide
ctcgcattataaagggccggtgggc

SEQ ID NO: 1021 - DNA, 24 bp, Artificial
  synthetic oligonucleotide
  modified_base (7)..(7): c or methylated C nucleotide
  modified_base (18)..(18): c or methylated C nucleotide
ggtgggcggagagttagcgagaga

SEQ ID NO: 1022 - DNA, 24 bp, Artificial
  synthetic oligonucleotide
  modified_base (4)..(4): c or methylated C nucleotide
  modified_base (15)..(15): c or methylated C nucleotide
gggcggagagttagcgagagagga

SEQ ID NO: 1023 - DNA, 24 bp, Artificial
  synthetic oligonucleotide
  modified_base (1)..(1): c or methylated C nucleotide
  modified_base (12)..(12): c or methylated C nucleotide
cggagagttagcgagagaggatct

SEQ ID NO: 1024 - DNA, 24 bp, Artificial
  synthetic oligonucleotide
  modified_base (9)..(9): c or methylated C nucleotide
agagttagcgagagaggatctttt

SEQ ID NO: 1025 - DNA, 24 bp, Artificial
  synthetic oligonucleotide
  modified_base (6)..(6): c or methylated C nucleotide
gttagcgagagaggatcttttttc

SEQ ID NO: 1026 - DNA, 22 bp, Artificial
  synthetic oligonucleotide
  modified_base (1)..(1): c or methylated C nucleotide
  modified_base (8)..(8): c or methylated C nucleotide
  modified_base (19)..(19): c or methylated C nucleotide
cggtgggcggagagttagcgag

SEQ ID NO: 1027 - DNA, 20 bp, Artificial
  synthetic oligonucleotide
  modified_base (6)..(6): c or methylated C nucleotide
  modified_base (17)..(17): c or methylated C nucleotide
gtgggcggagagttagcgag

SEQ ID NO: 1028 - DNA, 18 bp, Artificial
  synthetic oligonucleotide
  modified_base (4)..(4): c or methylated C nucleotide
  modified_base (15)..(15): c or methylated C nucleotide
gggcggagagttagcgag

SEQ ID NO: 1029 - DNA, 16 bp, Artificial
  synthetic oligonucleotide
  modified_base (2)..(2): c or methylated C nucleotide
  modified_base (13)..(13): c or methylated C nucleotide
gcggagagttagcgag

SEQ ID NO: 1030 - DNA, 14 bp, Artificial
  synthetic oligonucleotide
  modified_base (11)..(11): c or methylated C nucleotide
ggagagttagcgag

SEQ ID NO: 1031 - DNA, 22 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagcg

SEQ ID NO: 1032 - DNA, 20 bp, Artificial
  synthetic oligonucleotide
  modified_base (3)..(3): c or methylated C nucleotide
  modified_base (10)..(10): c or methylated C nucleotide
gccggtgggcggagagttag

SEQ ID NO: 1033 - DNA, 18 bp, Artificial
  synthetic oligonucleotide
  modified_base (3)..(3): c or methylated C nucleotide
  modified_base (10)..(10): c or methylated C nucleotide
gccggtgggcggagagtt

SEQ ID NO: 1034 - DNA, 16 bp, Artificial
  synthetic oligonucleotide
  modified_base (3)..(3): c or methylated C nucleotide
  modified_base (10)..(10): c or methylated C nucleotide
gccggtgggcggagag

SEQ ID NO: 1035 - DNA, 15 bp, Artificial
  synthetic oligonucleotide
  modified_base (3)..(3): c or methylated C nucleotide
  modified_base (10)..(10): c or methylated C nucleotide
gccggtgggcggaga

SEQ ID NO: 1036 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggtgagttagcgag

SEQ ID NO: 1037 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtcggcggagagttagcgag

SEQ ID NO: 1038 - DNA, 24 bp, Artificial
  synthetic oligonucleotide
  modified_base (3)..(3): c or methylated C nucleotide
  modified_base (10)..(10): c or methylated C nucleotide
  modified_base (21)..(21): c or methylated C nucleotide
gccggtgggcggagagttagctag

SEQ ID NO: 1039 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgt

SEQ ID NO: 1040 - DNA, 29 bp, Artificial
  synthetic oligonucleotide
  modified_base (4)..(4): c or methylated C nucleotide
  modified_base (6)..(6): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
  modified_base (27)..(27): c or methylated C nucleotide
ctgcgcgcccaccgccacgccacgcgcgt

SEQ ID NO: 1041 - DNA, 30 bp, Artificial
  synthetic oligonucleotide
  modified_base (5)..(5): c or methylated C nucleotide
  modified_base (7)..(7): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
  modified_base (28)..(28): c or methylated C nucleotide
actgcgcgcccaccgccacgccacgcgcgt

SEQ ID NO: 1042 - DNA, 31 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
  modified_base (29)..(29): c or methylated C nucleotide
cactgcgcgcccaccgccacgccacgcgcgt

SEQ ID NO: 1043 - DNA, 32 bp, Artificial
  synthetic oligonucleotide
  modified_base (7)..(7): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (26)..(26): c or methylated C nucleotide
  modified_base (28)..(28): c or methylated C nucleotide
  modified_base (30)..(30): c or methylated C nucleotide
ccactgcgcgcccaccgccacgccacgcgcgt

SEQ ID NO: 1044 - DNA, 33 bp, Artificial
  synthetic oligonucleotide
  modified_base (8)..(8): c or methylated C nucleotide
  modified_base (10)..(10): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
  modified_base (31)..(31): c or methylated C nucleotide
accactgcgcgcccaccgccacgccacgcgcgt

SEQ ID NO: 1045 - DNA, 29 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgta

SEQ ID NO: 1046 - DNA, 30 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtac

SEQ ID NO: 1047 - DNA, 31 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtacc

SEQ ID NO: 1048 - DNA, 32 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtacca

SEQ ID NO: 1049 - DNA, 33 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgcgtaccag

SEQ ID NO: 1050 - DNA, 30 bp, Artificial
  synthetic oligonucleotide
  modified_base (4)..(4): c or methylated C nucleotide
  modified_base (6)..(6): c or methylated C nucleotide
  modified_base (13)..(13): c or methylated C nucleotide
  modified_base (18)..(18): c or methylated C nucleotide
  modified_base (23)..(23): c or methylated C nucleotide
  modified_base (25)..(25): c or methylated C nucleotide
  modified_base (27)..(27): c or methylated C nucleotide
ctgcgcgcccaccgccacgccacgcgcgta

SEQ ID NO: 1051 - DNA, 32 bp, Artificial
  synthetic oligonucleotide
  modified_base (5)..(5): c or methylated C nucleotide
  modified_base (7)..(7): c or methylated C nucleotide
  modified_base (14)..(14): c or methylated C nucleotide
  modified_base (19)..(19): c or methylated C nucleotide
  modified_base (24)..(24): c or methylated C nucleotide
  modified_base (26)..(26): c or methylated C nucleotide
  modified_base (28)..(28): c or methylated C nucleotide
actgcgcgcccaccgccacgccacgcgcgtac

SEQ ID NO: 1052 - DNA, 34 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
  modified_base (29)..(29): c or methylated C nucleotide
cactgcgcgcccaccgccacgccacgcgcgtacc

SEQ ID NO: 1053 - DNA, 36 bp, Artificial
  synthetic oligonucleotide
  modified_base (7)..(7): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (26)..(26): c or methylated C nucleotide
  modified_base (28)..(28): c or methylated C nucleotide
  modified_base (30)..(30): c or methylated C nucleotide
ccactgcgcgcccaccgccacgccacgcgcgtacca

SEQ ID NO: 1054 - DNA, 38 bp, Artificial
  synthetic oligonucleotide
  modified_base (8)..(8): c or methylated C nucleotide
  modified_base (10)..(10): c or methylated C nucleotide
  modified_base (17)..(17): c or methylated C nucleotide
  modified_base (22)..(22): c or methylated C nucleotide
  modified_base (27)..(27): c or methylated C nucleotide
  modified_base (29)..(29): c or methylated C nucleotide
  modified_base (31)..(31): c or methylated C nucleotide
accactgcgcgcccaccgccacgccacgcgcgtaccag

SEQ ID NO: 1055 - DNA, 28 bp, Artificial
  synthetic oligonucleotide
  modified_base (6)..(6): c or methylated C nucleotide
  modified_base (8)..(8): c or methylated C nucleotide
  modified_base (15)..(15): c or methylated C nucleotide
  modified_base (20)..(20): c or methylated C nucleotide
  modified_base (25)..(25): c or methylated C nucleotide
  modified_base (27)..(27): c or methylated C nucleotide
cactgcgcgcccaccgccacgccacgcg

SEQ ID NO: 1056 - DNA, 28 bp, Artificial
  synthetic oligonucleotide
  modified_base (9)..(9): c or methylated C nucleotide
  modified_base (11)..(11): c or methylated C nucleotide
  modified_base (18)..(18): c or methylated C nucleotide
  modified_base (23)..(23): c or methylated C nucleotide
  modified_base (28)..(28): c or methylated C nucleotide
aaccactgcgcgcccaccgccacgccac

SEQ ID NO: 1057 - DNA, 28 bp, Artificial
  synthetic oligonucleotide
  modified_base (12)..(12): c or methylated C nucleotide
  modified_base (14)..(14): c or methylated C nucleotide
  modified_base (21)..(21): c or methylated C nucleotide
  modified_base (26)..(26): c or methylated C nucleotide
gagaaccactgcgcgcccaccgccacgc

SEQ ID NO: 1058 - DNA, 28 bp, Artificial
  synthetic oligonucleotide
  modified_base (15)..(15): c or methylated C nucleotide
  modified_base (17)..(17): c or methylated C nucleotide
  modified_base (24)..(24): c or methylated C nucleotide
accgagaaccactgcgcgcccaccgcca

SEQ ID NO: 1059 - DNA, 28 bp, Artificial
  synthetic oligonucleotide
  modified_base (18)..(18): c or methylated C nucleotide
  modified_base (20)..(20): c or methylated C nucleotide
  modified_base (27)..(27): c or methylated C nucleotide
cacaccgagaaccactgcgcgcccaccg

SEQ ID NO: 1060 - DNA, 28 bp, Artificial
  synthetic oligonucleotide
  modified_base (2)..(2): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (21)..(21): c or methylated C nucleotide
  modified_base (23)..(23): c or methylated C nucleotide
gcgcccaccgccacgccacgcgcgtacc

SEQ ID NO: 1061 - DNA, 28 bp, Artificial
  synthetic oligonucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (20)..(20): c or methylated C nucleotide
cccaccgccacgccacgcgcgtaccagg

SEQ ID NO: 1062 - DNA, 28 bp, Artificial
  synthetic oligonucleotide
  modified_base (3)..(3): c or methylated C nucleotide
  modified_base (8)..(8): c or methylated C nucleotide
  modified_base (13)..(13): c or methylated C nucleotide
  modified_base (15)..(15): c or methylated C nucleotide
  modified_base (17)..(17): c or methylated C nucleotide
accgccacgccacgcgcgtaccaggctg

SEQ ID NO: 1063 - DNA, 28 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
  modified_base (14)..(14): c or methylated C nucleotide
gccacgccacgcgcgtaccaggctgcag

SEQ ID NO: 1064 - DNA, 26 bp, Artificial
  synthetic oligonucleotide
  modified_base (1)..(1): c or methylated C nucleotide
  modified_base (3)..(3): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (22)..(22): c or methylated C nucleotide
  modified_base (24)..(24): c or methylated C nucleotide
cgcgcccaccgccacgccacgcgcgt

SEQ ID NO: 1065 - DNA, 24 bp, Artificial
  synthetic oligonucleotide
  modified_base (1)..(1): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (20)..(20): c or methylated C nucleotide
  modified_base (22)..(22): c or methylated C nucleotide
cgcccaccgccacgccacgcgcgt

SEQ ID NO: 1066 - DNA, 22 bp, Artificial
  synthetic oligonucleotide
  modified_base (6)..(6): c or methylated C nucleotide
  modified_base (11)..(11): c or methylated C nucleotide
  modified_base (16)..(16): c or methylated C nucleotide
  modified_base (18)..(18): c or methylated C nucleotide
  modified_base (20)..(20): c or methylated C nucleotide
cccaccgccacgccacgcgcgt

SEQ ID NO: 1067 - DNA, 20 bp, Artificial
  synthetic oligonucleotide
  modified_base (4)..(4): c or methylated C nucleotide
  modified_base (9)..(9): c or methylated C nucleotide
  modified_base (14)..(14): c or methylated C nucleotide
  modified_base (16)..(16): c or methylated C nucleotide
  modified_base (18)..(18): c or methylated C nucleotide
caccgccacgccacgcgcgt

SEQ ID NO: 1068 - DNA, 18 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (14)..(14): c or methylated C nucleotide
  modified_base (16)..(16): c or methylated C nucleotide
ccgccacgccacgcgcgt

SEQ ID NO: 1069 - DNA, 16 bp, Artificial
  synthetic oligonucleotide
  modified_base (5)..(5): c or methylated C nucleotide
  modified_base (10)..(10): c or methylated C nucleotide
  modified_base (12)..(12): c or methylated C nucleotide
  modified_base (14)..(14): c or methylated C nucleotide
gccacgccacgcgcgt

SEQ ID NO: 1070 - DNA, 15 bp, Artificial
  synthetic oligonucleotide
  modified_base (4)..(4): c or methylated C nucleotide
  modified_base (9)..(9): c or methylated C nucleotide
  modified_base (11)..(11): c or methylated C nucleotide
  modified_base (13)..(13): c or methylated C nucleotide
ccacgccacgcgcgt

SEQ ID NO: 1071 - DNA, 26 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccacgccacgcgc

SEQ ID NO: 1072 - DNA, 24 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
tgcgcgcccaccgccacgccacgc

SEQ ID NO: 1073 - DNA, 22 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
tgcgcgcccaccgccacgccac

SEQ ID NO: 1074 - DNA, 20 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
tgcgcgcccaccgccacgcc

SEQ ID NO: 1075 - DNA, 18 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
tgcgcgcccaccgccacg

SEQ ID NO: 1076 - DNA, 16 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
tgcgcgcccaccgcca

SEQ ID NO: 1077 - DNA, 15 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
tgcgcgcccaccgcc

SEQ ID NO: 1078 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccaccgccgcgccacgcgcgt

SEQ ID NO: 1079 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgtccaccgccacgccacgcgcgt

SEQ ID NO: 1080 - DNA, 28 bp, Artificial
  synthetic oligonucleotide
  modified_base (3)..(3): c or methylated C nucleotide
  modified_base (5)..(5): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (24)..(24): c or methylated C nucleotide
  modified_base (26)..(26): c or methylated C nucleotide
tgcgcgcccgccgccacgccacgcgcgt

SEQ ID NO: 1081 - DNA, 1300 bp, Homo sapiens
gagctccgggtacctggagaacatgaatctcccgggtgtactgtccccatgagggtcaccgaggaacctatggatcttccactcttcgcccagaatgtcttccctctatcccctccacctccccaaattccagcaccaggggccacctcagagccacaaatcctgaaaggaccacccaggtgactcgggcccacacacccctctttcggggtacacttggtggcaggctagcaggcttttggcctcagctggtggtgccatataaccagattcgtcacagagacccattttttatcagtcccaggccagaagtacgaagactgatcttaacgatgtggcctgcctgggaggtaaggcggcaggcgttgccagaattgatgggaactgtggcacaggtgggaaacctggtttaacaaattcttcattgattcaggggaccactttccttgagccaagtcttggcaagcggccggcgaaactcacaggtccctttcctggctgcgtccccagcctccagccttccccgccccagagatgccccaggagcggcccctcggtgtaggtaacgggtgcccgggcggctccgctccgccgcctagagcctggaagccgccactgcggcccaggacaatccggctacgcggccggcgccgaccccgcacgctggagtccgctgccgcacggcgctggcagtcgggggtggtgtctgaagtcaggcgcttcctgccttttcgtcggcccgggtgcccggctcgcgccgccaggctctgggatcccaggtcgccccgcccagcagcccgcgccctgctcggtgcgctcagcgtccccgccccttaccccaaacccccaccctctgtgccctcaggggggcacccccatcggggcgggaggggggggtcagctgtgccccggtcgccgagtggcgaggaggtgacggtagccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtacgtacgccggctgcggcgccccctgcgccgcgcgacaccctgcttcccccggtccccgccgagttcccctttccgggggtttctgcgcccgcctgggagagtggagagaagcg

SEQ ID NO: 1082 - DNA, 30 bp, Artificial
  synthetic oligonucleotide
  modified_base (2)..(2): c or methylated C nucleotide
  modified_base (5)..(5): c or methylated C nucleotide
  modified_base (7)..(7): c or methylated C nucleotide
  modified_base (15)..(15): c or methylated C nucleotide
  modified_base (27)..(27): c or methylated C nucleotide
ccggcgcgggagggcggagggaggaccgta

SEQ ID NO: 1083 - DNA, 27 bp, Artificial
  synthetic oligonucleotide
  modified_base (2)..(2): c or methylated C nucleotide
  modified_base (7)..(7): c or methylated C nucleotide
  modified_base (12)..(12): c or methylated C nucleotide
  modified_base (19)..(19): c or methylated C nucleotide
  modified_base (22)..(22): c or methylated C nucleotide
  modified_base (25)..(25): c or methylated C nucleotide
tcgccccgcagcgctgcccgccggcgg

SEQ ID NO: 1084 - DNA, 27 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (25)..(25): c or methylated C nucleotide
aggggcggggacgctgagcggcaccga

SEQ ID NO: 1085 - DNA, 25 bp, Artificial
  synthetic oligonucleotide
  modified_base (5)..(5): c or methylated C nucleotide
  modified_base (7)..(7): c or methylated C nucleotide
  modified_base (19)..(19): c or methylated C nucleotide
  modified_base (23)..(23): c or methylated C nucleotide
agggcgcgggctgctgggcgggcga

SEQ ID NO: 1086 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacga

SEQ ID NO: 1087 - DNA, 28 bp, Artificial
  synthetic oligonucleotide
  modified_base (3)..(3): c or methylated C nucleotide
  modified_base (7)..(7): c or methylated C nucleotide
  modified_base (13)..(13): c or methylated C nucleotide
  modified_base (16)..(16): c or methylated C nucleotide
  modified_base (19)..(19): c or methylated C nucleotide
  modified_base (23)..(23): c or methylated C nucleotide
  modified_base (25)..(25): c or methylated C nucleotide
agcgtgcggggtcggcgccggccgcgta

SEQ ID NO: 1088 - DNA, 29 bp, Artificial
  synthetic oligonucleotide
  modified_base (2)..(2): c or methylated C nucleotide
  modified_base (5)..(5): c or methylated C nucleotide
  modified_base (9)..(9): c or methylated C nucleotide
  modified_base (15)..(15): c or methylated C nucleotide
  modified_base (19)..(19): c or methylated C nucleotide
  modified_base (27)..(27): c or methylated C nucleotide
gcggcggacggagccgcccgggcacccgt

SEQ ID NO: 1089 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcgg

SEQ ID NO: 1090 - DNA, 26 bp, Artificial
  synthetic oligonucleotide
  modified_base (3)..(3): c or methylated C nucleotide
  modified_base (25)..(25): c or methylated C nucleotide
gccgctcctggggcatctctggggcg

SEQ ID NO: 1091 - DNA, 31 bp, Artificial
  synthetic oligonucleotide
  modified_base (2)..(2): c or methylated C nucleotide
  modified_base (9)..(9): c or methylated C nucleotide
  modified_base (16)..(16): c or methylated C nucleotide
  modified_base (21)..(21): c or methylated C nucleotide
  modified_base (24)..(24): c or methylated C nucleotide
  modified_base (27)..(27): c or methylated C nucleotide
  modified_base (29)..(29): c or methylated C nucleotide
gcggtgcccgagtggcggagcggcgccgcgg

SEQ ID NO: 1092 - DNA, 27 bp, Artificial
  synthetic oligonucleotide
  modified_base (2)..(2): c or methylated C nucleotide
  modified_base (6)..(6): c or methylated C nucleotide
  modified_base (10)..(10): c or methylated C nucleotide
acgggcgggcgggcagcaggctctcca

SEQ ID NO: 1093 - DNA, 30 bp, Artificial
  synthetic oligonucleotide
  modified_base (2)..(2): c or methylated C nucleotide
  modified_base (28)..(28): c or methylated C nucleotide
ccgccttacctcccaggcaggccacatcgt

SEQ ID NO: 1094 - DNA, 25 bp, Artificial
  synthetic oligonucleotide
  modified_base (2)..(2): c or methylated C nucleotide
  modified_base (23)..(23): c or methylated C nucleotide
ccgaaagaggggtgtgtgggcccga

SEQ ID NO: 1095 - DNA, 25 bp, Artificial
  synthetic oligonucleotide
catgttctccaggtacccggagctc

SEQ ID NO: 1096 - DNA, 31 bp, Artificial
  synthetic oligonucleotide
cggtgaccctcatggggacagtacacccggg

SEQ ID NO: 1097 - DNA, 30 bp, Artificial
  synthetic oligonucleotide
gatagagggaagacattctgggcgaagagt

SEQ ID NO: 1098 - DNA, 28 bp, Artificial
  synthetic oligonucleotide
gtgagtttcgccggccgcttgccaagac

SEQ ID NO: 1099 - DNA, 27 bp, Artificial
  synthetic oligonucleotide
ccgcgtagccggattgtcctgggccgc

SEQ ID NO: 1100 - DNA, 21 bp, Artificial
  synthetic oligonucleotide
cgccgtgcggcagcggactcc

SEQ ID NO: 1101 - DNA, 26 bp, Artificial
  synthetic oligonucleotide
gcgcctgacttcagacaccacccccg

SEQ ID NO: 1102 - DNA, 37 bp, Artificial
  synthetic oligonucleotide
gcgaccggggcacagctgacccccccctcccgccccg

SEQ ID NO: 1103 - DNA, 28 bp, Artificial
  synthetic oligonucleotide
gcggctaccgtcacctcctcgccactcg

SEQ ID NO: 1104 - DNA, 25 bp, Artificial
  synthetic oligonucleotide
gcgaacagggcgagctgtccagccg

SEQ ID NO: 1105 - DNA, 25 bp, Artificial
  synthetic oligonucleotide
gccacgggcgggtctgcactcagcg

SEQ ID NO: 1106 - DNA, 28 bp, Artificial
  synthetic oligonucleotide
gggtctctgtgacgaatctggtgtgtgg

SEQ ID NO: 1107 - DNA, 24 bp, Artificial
  synthetic oligonucleotide
cagttcccatcaattctgcaacgc

SEQ ID NO: 1108 - DNA, 25 bp, Artificial
  synthetic oligonucleotide
gcgggggaaaaagacgcagactagg

SEQ ID NO: 1109 - DNA, 31 bp, Artificial
  synthetic oligonucleotide
gacgtgctgttctccaaggcctggcacgcag

SEQ ID NO: 1110 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccga

SEQ ID NO: 1111 - DNA, 27 bp, Artificial
  synthetic oligonucleotide
  modified_base (7)..(7): c or methylated C nucleotide
  modified_base (13)..(13): c or methylated C nucleotide
  modified_base (20)..(20): c or methylated C nucleotide
  modified_base (25)..(25): c or methylated C nucleotide
aaggggcggggacgctgagcgcaccga

SEQ ID NO: 1112 - DNA, 28 bp, Artificial
  synthetic oligonucleotide
  modified_base (8)..(8): c or methylated C nucleotide
  modified_base (14)..(14): c or methylated C nucleotide
  modified_base (21)..(21): c or methylated C nucleotide
  modified_base (26)..(26): c or methylated C nucleotide
taaggggcggggacgctgagcgcaccga

SEQ ID NO: 1113 - DNA, 29 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
  modified_base (27)..(27): c or methylated C nucleotide
gtaaggggcggggacgctgagcgcaccga

SEQ ID NO: 1114 - DNA, 30 bp, Artificial
  synthetic oligonucleotide
  modified_base (10)..(10): c or methylated C nucleotide
  modified_base (16)..(16): c or methylated C nucleotide
  modified_base (23)..(23): c or methylated C nucleotide
  modified_base (28)..(28): c or methylated C nucleotide
ggtaaggggcggggacgctgagcgcaccga

SEQ ID NO: 1115 - DNA, 31 bp, Artificial
  synthetic oligonucleotide
  modified_base (11)..(11): c or methylated C nucleotide
  modified_base (17)..(17): c or methylated C nucleotide
  modified_base (24)..(24): c or methylated C nucleotide
  modified_base (29)..(29): c or methylated C nucleotide
gggtaaggggcggggacgctgagcgcaccga

SEQ ID NO: 1116 - DNA, 27 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgag

SEQ ID NO: 1117 - DNA, 28 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagc

SEQ ID NO: 1118 - DNA, 29 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagca

SEQ ID NO: 1119 - DNA, 30 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagcag

SEQ ID NO: 1120 - DNA, 31 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcaccgagcagg

SEQ ID NO: 1121 - DNA, 28 bp, Artificial
  synthetic oligonucleotide
  modified_base (7)..(7): c or methylated C nucleotide
  modified_base (13)..(13): c or methylated C nucleotide
  modified_base (20)..(20): c or methylated C nucleotide
  modified_base (25)..(25): c or methylated C nucleotide
aaggggcggggacgctgagcgcaccgag

SEQ ID NO: 1122 - DNA, 30 bp, Artificial
  synthetic oligonucleotide
  modified_base (8)..(8): c or methylated C nucleotide
  modified_base (14)..(14): c or methylated C nucleotide
  modified_base (21)..(21): c or methylated C nucleotide
  modified_base (26)..(26): c or methylated C nucleotide
taaggggcggggacgctgagcgcaccgagc

SEQ ID NO: 1123 - DNA, 32 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
  modified_base (27)..(27): c or methylated C nucleotide
gtaaggggcggggacgctgagcgcaccgagca

SEQ ID NO: 1124 - DNA, 34 bp, Artificial
  synthetic oligonucleotide
  modified_base (10)..(10): c or methylated C nucleotide
  modified_base (16)..(16): c or methylated C nucleotide
  modified_base (23)..(23): c or methylated C nucleotide
  modified_base (28)..(28): c or methylated C nucleotide
ggtaaggggcggggacgctgagcgcaccgagcag

SEQ ID NO: 1125 - DNA, 36 bp, Artificial
  synthetic oligonucleotide
  modified_base (11)..(11): c or methylated C nucleotide
  modified_base (17)..(17): c or methylated C nucleotide
  modified_base (24)..(24): c or methylated C nucleotide
  modified_base (29)..(29): c or methylated C nucleotide
gggtaaggggcggggacgctgagcgcaccgagcagg

SEQ ID NO: 1126 - DNA, 26 bp, Artificial
  synthetic oligonucleotide
  modified_base (9)..(9): c or methylated C nucleotide
  modified_base (15)..(15): c or methylated C nucleotide
  modified_base (22)..(22): c or methylated C nucleotide
gtaaggggcggggacgctgagcgcac

SEQ ID NO: 1127 - DNA, 26 bp, Artificial
  synthetic oligonucleotide
  modified_base (12)..(12): c or methylated C nucleotide
  modified_base (18)..(18): c or methylated C nucleotide
  modified_base (25)..(25): c or methylated C nucleotide
ggggtaaggggcggggacgctgagcg

SEQ ID NO: 1128 - DNA, 27 bp, Artificial
  synthetic oligonucleotide
  modified_base (15)..(15): c or methylated C nucleotide
  modified_base (21)..(21): c or methylated C nucleotide
tttggggtaaggggcggggacgctgag

SEQ ID NO: 1129 - DNA, 27 bp, Artificial
  synthetic oligonucleotide
  modified_base (18)..(18): c or methylated C nucleotide
  modified_base (24)..(24): c or methylated C nucleotide
gggtttggggtaaggggcggggacgct

SEQ ID NO: 1130 - DNA, 27 bp, Artificial
  synthetic oligonucleotide
  modified_base (21)..(21): c or methylated C nucleotide
  modified_base (27)..(27): c or methylated C nucleotide
tgggggtttggggtaaggggcggggac

SEQ ID NO: 1131 - DNA, 26 bp, Artificial
  synthetic oligonucleotide
  modified_base (3)..(3): c or methylated C nucleotide
  modified_base (9)..(9): c or methylated C nucleotide
  modified_base (16)..(16): c or methylated C nucleotide
  modified_base (21)..(21): c or methylated C nucleotide
ggcggggacgctgagcgcaccgagca

SEQ ID NO: 1132 - DNA, 26 bp, Artificial
  synthetic oligonucleotide
  modified_base (6)..(6): c or methylated C nucleotide
  modified_base (13)..(13): c or methylated C nucleotide
  modified_base (18)..(18): c or methylated C nucleotide
ggggacgctgagcgcaccgagcaggg

SEQ ID NO: 1133 - DNA, 26 bp, Artificial
  synthetic oligonucleotide
  modified_base (3)..(3): c or methylated C nucleotide
  modified_base (10)..(10): c or methylated C nucleotide
  modified_base (15)..(15): c or methylated C nucleotide
gacgctgagcgcaccgagcagggcgc

SEQ ID NO: 1134 - DNA, 26 bp, Artificial
  synthetic oligonucleotide
  modified_base (7)..(7): c or methylated C nucleotide
  modified_base (12)..(12): c or methylated C nucleotide
gctgagcgcaccgagcagggcgcggg

SEQ ID NO: 1135 - DNA, 26 bp, Artificial
  synthetic oligonucleotide
  modified_base (4)..(4): c or methylated C nucleotide
  modified_base (9)..(9): c or methylated C nucleotide
gagcgcaccgagcagggcgcgggctg

SEQ ID NO: 1136 - DNA, 24 bp, Artificial
  synthetic oligonucleotide
  modified_base (4)..(4): c or methylated C nucleotide
  modified_base (10)..(10): c or methylated C nucleotide
  modified_base (17)..(17): c or methylated C nucleotide
  modified_base (22)..(22): c or methylated C nucleotide
gggcggggacgctgagcgcaccga

SEQ ID NO: 1137 - DNA, 22 bp, Artificial
  synthetic oligonucleotide
  modified_base (2)..(2): c or methylated C nucleotide
  modified_base (8)..(8): c or methylated C nucleotide
  modified_base (15)..(15): c or methylated C nucleotide
  modified_base (20)..(20): c or methylated C nucleotide
gcggggacgctgagcgcaccga

SEQ ID NO: 1138 - DNA, 20 bp, Artificial
  synthetic oligonucleotide
  modified_base (6)..(6): c or methylated C nucleotide
  modified_base (13)..(13): c or methylated C nucleotide
  modified_base (18)..(18): c or methylated C nucleotide
ggggacgctgagcgcaccga

SEQ ID NO: 1139 - DNA, 18 bp, Artificial
  synthetic oligonucleotide
  modified_base (4)..(4): c or methylated C nucleotide
  modified_base (11)..(11): c or methylated C nucleotide
  modified_base (16)..(16): c or methylated C nucleotide
ggacgctgagcgcaccga

SEQ ID NO: 1140 - DNA, 16 bp, Artificial
  synthetic oligonucleotide
  modified_base (2)..(2): c or methylated C nucleotide
  modified_base (9)..(9): c or methylated C nucleotide
  modified_base (14)..(14): c or methylated C nucleotide
acgctgagcgcaccga

SEQ ID NO: 1141 - DNA, 14 bp, Artificial
  synthetic oligonucleotide
  modified_base (7)..(7): c or methylated C nucleotide
  modified_base (12)..(12): c or methylated C nucleotide
gctgagcgcaccga

SEQ ID NO: 1142 - DNA, 24 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgagcgcacc

SEQ ID NO: 1143 - DNA, 22 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagcgca

SEQ ID NO: 1144 - DNA, 20 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagcg

SEQ ID NO: 1145 - DNA, 19 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
aggggcggggacgctgagc

SEQ ID NO: 1146 - DNA, 17 bp, Artificial
  synthetic oligonucleotide
  modified_base (6)..(6): c or methylated C nucleotide
  modified_base (12)..(12): c or methylated C nucleotide
aggggcggggacgctga

SEQ ID NO: 1147 - DNA, 15 bp, Artificial
  synthetic oligonucleotide
  modified_base (6)..(6): c or methylated C nucleotide
  modified_base (12)..(12): c or methylated C nucleotide
aggggcggggacgct

SEQ ID NO: 1148 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcgaggacgctgagcgcaccga

SEQ ID NO: 1149 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctgatcgcaccga

SEQ ID NO: 1150 - DNA, 26 bp, Artificial
  synthetic oligonucleotide
  modified_base (6)..(6): c or methylated C nucleotide
  modified_base (12)..(12): c or methylated C nucleotide
  modified_base (19)..(19): c or methylated C nucleotide
  modified_base (24)..(24): c or methylated C nucleotide
aggggcggggacgctcagcgcaccga

SEQ ID NO: 1151 - DNA, 35 bp, Artificial; identical to SEQ ID NO: 1086
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide

SEQ ID NO: 1152 - DNA, 36 bp, Artificial
  synthetic oligonucleotide
  modified_base (8)..(8): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (26)..(26): c or methylated C nucleotide
  modified_base (31)..(31): c or methylated C nucleotide
  modified_base (34)..(34): c or methylated C nucleotide
agcctggcggcgcgagccgggcacccgggccgacga

SEQ ID NO: 1153 - DNA, 37 bp, Artificial
  synthetic oligonucleotide
  modified_base (9)..(9): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (27)..(27): c or methylated C nucleotide
  modified_base (32)..(32): c or methylated C nucleotide
  modified_base (35)..(35): c or methylated C nucleotide
gagcctggcggcgcgagccgggcacccgggccgacga

SEQ ID NO: 1154 - DNA, 38 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
  modified_base (36)..(36): c or methylated C nucleotide
agagcctggcggcgcgagccgggcacccgggccgacga

SEQ ID NO: 1155 - DNA, 39 bp, Artificial
  synthetic oligonucleotide
  modified_base (11)..(11): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (29)..(29): c or methylated C nucleotide
  modified_base (34)..(34): c or methylated C nucleotide
  modified_base (37)..(37): c or methylated C nucleotide
cagagcctggcggcgcgagccgggcacccgggccgacga

SEQ ID NO: 1156 - DNA, 40 bp, Artificial
  synthetic oligonucleotide
  modified_base (12)..(12): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (30)..(30): c or methylated C nucleotide
  modified_base (35)..(35): c or methylated C nucleotide
  modified_base (38)..(38): c or methylated C nucleotide
ccagagcctggcggcgcgagccgggcacccgggccgacga

SEQ ID NO: 1157 - DNA, 36 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaa

SEQ ID NO: 1158 - DNA, 37 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaa

SEQ ID NO: 1159 - DNA, 38 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaa

SEQ ID NO: 1160 - DNA, 39 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaag

SEQ ID NO: 1161 - DNA, 40 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgacgaaaagg

SEQ ID NO: 1162 - DNA, 37 bp, Artificial
  synthetic oligonucleotide
  modified_base (8)..(8): c or methylated C nucleotide
  modified_base (11)..(11): c or methylated C nucleotide
  modified_base (13)..(13): c or methylated C nucleotide
  modified_base (18)..(18): c or methylated C nucleotide
  modified_base (26)..(26): c or methylated C nucleotide
  modified_base (31)..(31): c or methylated C nucleotide
  modified_base (34)..(34): c or methylated C nucleotide
agcctggcggcgcgagccgggcacccgggccgacgaa

SEQ ID NO: 1163 - DNA, 39 bp, Artificial
  synthetic oligonucleotide
  modified_base (9)..(9): c or methylated C nucleotide
  modified_base (12)..(12): c or methylated C nucleotide
  modified_base (14)..(14): c or methylated C nucleotide
  modified_base (19)..(19): c or methylated C nucleotide
  modified_base (27)..(27): c or methylated C nucleotide
  modified_base (32)..(32): c or methylated C nucleotide
  modified_base (35)..(35): c or methylated C nucleotide
gagcctggcggcgcgagccgggcacccgggccgacgaaa

SEQ ID NO: 1164 - DNA, 41 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
  modified_base (36)..(36): c or methylated C nucleotide
agagcctggcggcgcgagccgggcacccgggccgacgaaaa

SEQ ID NO: 1165 - DNA, 43 bp, Artificial
  synthetic oligonucleotide
  modified_base (11)..(11): c or methylated C nucleotide
  modified_base (14)..(14): c or methylated C nucleotide
  modified_base (16)..(16): c or methylated C nucleotide
  modified_base (21)..(21): c or methylated C nucleotide
  modified_base (29)..(29): c or methylated C nucleotide
  modified_base (34)..(34): c or methylated C nucleotide
  modified_base (37)..(37): c or methylated C nucleotide
cagagcctggcggcgcgagccgggcacccgggccgacgaaaag

SEQ ID NO: 1166 - DNA, 45 bp, Artificial
  synthetic oligonucleotide
  modified_base (12)..(12): c or methylated C nucleotide
  modified_base (15)..(15): c or methylated C nucleotide
  modified_base (17)..(17): c or methylated C nucleotide
  modified_base (22)..(22): c or methylated C nucleotide
  modified_base (30)..(30): c or methylated C nucleotide
  modified_base (35)..(35): c or methylated C nucleotide
  modified_base (38)..(38): c or methylated C nucleotide
ccagagcctggcggcgcgagccgggcacccgggccgacgaaaagg

SEQ ID NO: 1167 - DNA, 35 bp, Artificial
  synthetic oligonucleotide
  modified_base (10)..(10): c or methylated C nucleotide
  modified_base (13)..(13): c or methylated C nucleotide
  modified_base (15)..(15): c or methylated C nucleotide
  modified_base (20)..(20): c or methylated C nucleotide
  modified_base (28)..(28): c or methylated C nucleotide
  modified_base (33)..(33): c or methylated C nucleotide
agagcctggcggcgcgagccgggcacccgggccga

SEQ ID NO: 1168 - DNA, 35 bp, Artificial
  synthetic oligonucleotide
  modified_base (13)..(13): c or methylated C nucleotide
  modified_base (16)..(16): c or methylated C nucleotide
  modified_base (18)..(18): c or methylated C nucleotide
  modified_base (23)..(23): c or methylated C nucleotide
  modified_base (31)..(31): c or methylated C nucleotide
cccagagcctggcggcgcgagccgggcacccgggc

SEQ ID NO: 1169 - DNA, 35 bp, Artificial
  synthetic oligonucleotide
  modified_base (16)..(16): c or methylated C nucleotide
  modified_base (19)..(19): c or methylated C nucleotide
  modified_base (21)..(21): c or methylated C nucleotide
  modified_base (26)..(26): c or methylated C nucleotide
  modified_base (34)..(34): c or methylated C nucleotide
gatcccagagcctggcggcgcgagccgggcacccg

SEQ ID NO: 1170 - DNA, 35 bp, Artificial
  synthetic oligonucleotide
  modified_base (19)..(19): c or methylated C nucleotide
  modified_base (22)..(22): c or methylated C nucleotide
  modified_base (24)..(24): c or methylated C nucleotide
  modified_base (29)..(29): c or methylated C nucleotide
tgggatcccagagcctggcggcgcgagccgggcac

SEQ ID NO: 1171 - DNA, 35 bp, Artificial
  synthetic oligonucleotide
  modified_base (22)..(22): c or methylated C nucleotide
  modified_base (25)..(25): c or methylated C nucleotide
  modified_base (27)..(27): c or methylated C nucleotide
  modified_base (32)..(32): c or methylated C nucleotide
acctgggatcccagagcctggcggcgcgagccggg

SEQ ID NO: 1172 - DNA, 35 bp, Artificial
  synthetic oligonucleotide
  modified_base (4)..(4): c or methylated C nucleotide
  modified_base (7)..(7): c or methylated C nucleotide
  modified_base (9)..(9): c or methylated C nucleotide
  modified_base (14)..(14): c or methylated C nucleotide
  modified_base (22)..(22): c or methylated C nucleotide
  modified_base (27)..(27): c or methylated C nucleotide
  modified_base (30)..(30): c or methylated C nucleotide
tggcggcgcgagccgggcacccgggccgacgaaaa

SEQ ID NO: 1173 - DNA, 35 bp, Artificial
  synthetic oligonucleotide
  modified_base (1)..(1): c or methylated C nucleotide
  modified_base (4)..(4): c or methylated C nucleotide
  modified_base (6)..(6): c or methylated C nucleotide
  modified_base (11)..(11): c or methylated C nucleotide
  modified_base (19)..(19): c or methylated C nucleotide
  modified_base (24)..(24): c or methylated C nucleotide
  modified_base (27)..(27): c or methylated C nucleotide
cggcgcgagccgggcacccgggccgacgaaaaggc

SEQ ID NO: 1174 - DNA, 35 bp, Artificial
  synthetic oligonucleotide
  modified_base (1)..(1): c or methylated C nucleotide
  modified_base (3)..(3): c or methylated C nucleotide
  modified_base (8)..(8): c or methylated C nucleotide
  modified_base (16)..(16): c or methylated C nucleotide
  modified_base (21)..(21): c or methylated C nucleotide
  modified_base (24)..(24): c or methylated C nucleotide
cgcgagccgggcacccgggccgacgaaaaggcagg

SEQ ID NO: 1175 - DNA, 35 bp, Artificial
  synthetic oligonucleotide
  modified_base (5)..(5): c or methylated C nucleotide
  modified_base (13)..(13): c or methylated C nucleotide
  modified_base (18)..(18): c or methylated C nucleotide
  modified_base (21)..(21): c or methylated C nucleotide
gagccgggcacccgggccgacgaaaaggcaggaag

SEQ ID NO: 1176 - DNA, 35 bp, Artificial
  synthetic oligonucleotide
  modified_base (2)..(2): c or methylated C nucleotide
  modified_base (10)..(10): c or methylated C nucleotide
  modified_base (15)..(15): c or methylated C nucleotide
  modified_base (18)..(18): c or methylated C nucleotide
ccgggcacccgggccgacgaaaaggcaggaagcgc

SEQ ID NO: 1177 - DNA, 33 bp, Artificial
  synthetic oligonucleotide
  modified_base (5)..(5): c or methylated C nucleotide
  modified_base (8)..(8): c or methylated C nucleotide
  modified_base (10)..(10): c or methylated C nucleotide
  modified_base (15)..(15): c or methylated C nucleotide
  modified_base (23)..(23): c or methylated C nucleotide
  modified_base (28)..(28): c or methylated C nucleotide
  modified_base (31)..(31): c or methylated C nucleotide
ctggcggcgcgagccgggcacccgggccgacga

SEQ ID NO: 1178 - DNA, 31 bp, Artificial
  synthetic oligonucleotide
  modified_base (3)..(3): c or methylated C nucleotide
  modified_base (6)..(6): c or methylated C nucleotide
  modified_base (8)..(8): c or methylated C nucleotide
  modified_base (13)..(13): c or methylated C nucleotide
  modified_base (21)..(21): c or methylated C nucleotide
  modified_base (26)..(26): c or methylated C nucleotide
  modified_base (29)..(29): c or methylated C nucleotide
ggcggcgcgagccgggcacccgggccgacga

SEQ ID NO: 1179 - DNA, 29 bp, Artificial
  synthetic oligonucleotide
  modified_base (1)..(1): c or methylated C nucleotide
  modified_base (4)..(4): c or methylated C nucleotide
  modified_base (6)..(6): c or methylated C nucleotide
  modified_base (11)..(11): c or methylated C nucleotide
  modified_base (19)..(19): c or methylated C nucleotide
  modified_base (24)..(24): c or methylated C nucleotide
  modified_base (27)..(27): c or methylated C nucleotide
cggcgcgagccgggcacccgggccgacga

SEQ ID NO: 1180 - DNA, 27 bp, Artificial
  synthetic oligonucleotide
  modified_base (2)..(2): c or methylated C nucleotide
  modified_base (4)..(4): c or methylated C nucleotide
  modified_base (9)..(9): c or methylated C nucleotide
  modified_base (17)..(17): c or methylated C nucleotide
  modified_base (22)..(22): c or methylated C nucleotide
  modified_base (25)..(25): c or methylated C nucleotide
gcgcgagccgggcacccgggccgacga

SEQ ID NO: 1181 - DNA, 25 bp, Artificial
  synthetic oligonucleotide
  modified_base (2)..(2)
  modified_base (2)..(2): c or methylated C nucleotide
  modified_base (7)..(7)
  modified_base (15)..(15)
  modified_base (20)..(20)
  modified_base (23)..(23)
gcgagccgggcacccgggccgacga

SEQ ID NO: 1182 - DNA, 23 bp, Artificial
  synthetic oligonucleotide
  modified_base (5)..(5): c or methylated C nucleotide
  modified_base (13)..(13): c or methylated C nucleotide
  modified_base (18)..(18): c or methylated C nucleotide
  modified_base (21)..(21): c or methylated C nucleotide
gagccgggcacccgggccgacga

SEQ ID NO: 1183 - DNA, 21 bp, Artificial
  synthetic oligonucleotide
  modified_base (3)..(3): c or methylated C nucleotide
  modified_base (11)..(11): c or methylated C nucleotide
  modified_base (16)..(16): c or methylated C nucleotide
  modified_base (19)..(19): c or methylated C nucleotide
gccgggcacccgggccgacga

SEQ ID NO: 1184 - DNA, 19 bp, Artificial
  synthetic oligonucleotide
  modified_base (1)..(1): c or methylated C nucleotide
  modified_base (9)..(9): c or methylated C nucleotide
  modified_base (14)..(14): c or methylated C nucleotide
  modified_base (17)..(17): c or methylated C nucleotide
cgggcacccgggccgacga

SEQ ID NO: 1185 - DNA, 17 bp, Artificial
  synthetic oligonucleotide
  modified_base (7)..(7): c or methylated C nucleotide
  modified_base (12)..(12): c or methylated C nucleotide
  modified_base (15)..(15): c or methylated C nucleotide
ggcacccgggccgacga

SEQ ID NO: 1186 - DNA, 15 bp, Artificial
  synthetic oligonucleotide
  modified_base (5)..(5): c or methylated C nucleotide
  modified_base (10)..(10): c or methylated C nucleotide
  modified_base (13)..(13): c or methylated C nucleotide
cacccgggccgacga

SEQ ID NO: 1187 - DNA, 33 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggccgac

SEQ ID NO: 1188 - DNA, 31 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
gcctggcggcgcgagccgggcacccgggccg

SEQ ID NO: 1189 - DNA, 29 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcacccgggc

SEQ ID NO: 1190 - DNA, 27 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcacccgg

SEQ ID NO: 1191 - DNA, 25 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
gcctggcggcgcgagccgggcaccc

SEQ ID NO: 1192 - DNA, 23 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgggcac

SEQ ID NO: 1193 - DNA, 21 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgggc

SEQ ID NO: 1194 - DNA, 19 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagccgg

SEQ ID NO: 1195 - DNA, 17 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
gcctggcggcgcgagcc

SEQ ID NO: 1196 - DNA, 15 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
gcctggcggcgcgag

SEQ ID NO: 1197 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccaggcacccgggccgacga

SEQ ID NO: 1198 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcgccgcgagccgggcacccgggccgacga

SEQ ID NO: 1199 - DNA, 35 bp, Artificial
  synthetic oligonucleotide
  modified_base (7)..(7): c or methylated C nucleotide
  modified_base (10)..(10): c or methylated C nucleotide
  modified_base (12)..(12): c or methylated C nucleotide
  modified_base (17)..(17): c or methylated C nucleotide
  modified_base (25)..(25): c or methylated C nucleotide
  modified_base (30)..(30): c or methylated C nucleotide
  modified_base (33)..(33): c or methylated C nucleotide
gcctggcggcgcgagccgggcacccgggcctacga

SEQ ID NO: 1200 - DNA, 33 bp, Artificial; identical to SEQ ID NO: 1089
  synthetic oligonucleotide
  modified_base (4)..(4): c or methylated C nucleotide
  modified_base (9)..(9): c or methylated C nucleotide
  modified_base (31)..(31): c or methylated C nucleotide

SEQ ID NO: 1201 - DNA, 34 bp, Artificial
  synthetic oligonucleotide
  modified_base (5)..(5): c or methylated C nucleotide
  modified_base (10)..(10): c or methylated C nucleotide
  modified_base (32)..(32): c or methylated C nucleotide
tgggcggggcgacctgggatcccaggcctggcgg

SEQ ID NO: 1202 - DNA, 35 bp, Artificial
  synthetic oligonucleotide
  modified_base (6)..(6): c or methylated C nucleotide
  modified_base (11)..(11): c or methylated C nucleotide
  modified_base (33)..(33): c or methylated C nucleotide
ctgggcggggcgacctgggatcccaggcctggcgg

SEQ ID NO: 1203 - DNA, 36 bp, Artificial
  synthetic oligonucleotide
  modified_base (7)..(7): c or methylated C nucleotide
  modified_base (12)..(12): c or methylated C nucleotide
  modified_base (34)..(34): c or methylated C nucleotide
gctgggcggggcgacctgggatcccaggcctggcgg

SEQ ID NO: 1204 - DNA, 37 bp, Artificial
  synthetic oligonucleotide
  modified_base (8)..(8): c or methylated C nucleotide
  modified_base (13)..(13): c or methylated C nucleotide
  modified_base (35)..(35): c or methylated C nucleotide
tgctgggcggggcgacctgggatcccaggcctggcgg

SEQ ID NO: 1205 - DNA, 38 bp, Artificial
  synthetic oligonucleotide
  modified_base (9)..(9): c or methylated C nucleotide
  modified_base (14)..(14): c or methylated C nucleotide
  modified_base (36)..(36): c or methylated C nucleotide
ctgctgggcggggcgacctgggatcccaggcctggcgg

SEQ ID NO: 1206 - DNA, 34 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggc

SEQ ID NO: 1207 - DNA, 35 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcg

SEQ ID NO: 1208 - DNA, 36 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgc

SEQ ID NO: 1209 - DNA, 37 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgcg

SEQ ID NO: 1210 - DNA, 38 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggcggcgcga

SEQ ID NO: 1211 - DNA, 35 bp, Artificial
  synthetic oligonucleotide
  modified_base (5)..(5): c or methylated C nucleotide
  modified_base (10)..(10): c or methylated C nucleotide
  modified_base (32)..(32): c or methylated C nucleotide
tgggcggggcgacctgggatcccaggcctggcggc

SEQ ID NO: 1212 - DNA, 37 bp, Artificial
  synthetic oligonucleotide
  modified_base (6)..(6): c or methylated C nucleotide
  modified_base (11)..(11): c or methylated C nucleotide
  modified_base (33)..(33): c or methylated C nucleotide
ctgggcggggcgacctgggatcccaggcctggcggcg

SEQ ID NO: 1213 - DNA, 39 bp, Artificial
  synthetic oligonucleotide
  modified_base (7)..(7): c or methylated C nucleotide
  modified_base (12)..(12): c or methylated C nucleotide
  modified_base (34)..(34): c or methylated C nucleotide
gctgggcggggcgacctgggatcccaggcctggcggcgc

SEQ ID NO: 1214 - DNA, 41 bp, Artificial
  synthetic oligonucleotide
  modified_base (8)..(8): c or methylated C nucleotide
  modified_base (13)..(13): c or methylated C nucleotide
  modified_base (35)..(35): c or methylated C nucleotide
tgctgggcggggcgacctgggatcccaggcctggcggcgcg

SEQ ID NO: 1215 - DNA, 43 bp, Artificial
  synthetic oligonucleotide
  modified_base (9)..(9): c or methylated C nucleotide
  modified_base (14)..(14): c or methylated C nucleotide
  modified_base (36)..(36): c or methylated C nucleotide
ctgctgggcggggcgacctgggatcccaggcctggcggcgcga

SEQ ID NO: 1216 - DNA, 33 bp, Artificial
  synthetic oligonucleotide
  modified_base (7)..(7): c or methylated C nucleotide
  modified_base (12)..(12): c or methylated C nucleotide
gctgggcggggcgacctgggatcccaggcctgg

SEQ ID NO: 1217 - DNA, 33 bp, Artificial
  synthetic oligonucleotide
  modified_base (10)..(10): c or methylated C nucleotide
  modified_base (15)..(15): c or methylated C nucleotide
gctgctgggcggggcgacctgggatcccaggcc

SEQ ID NO: 1218 - DNA, 33 bp, Artificial
  synthetic oligonucleotide
  modified_base (13)..(13): c or methylated C nucleotide
  modified_base (18)..(18): c or methylated C nucleotide
cgggctgctgggcggggcgacctgggatcccag

SEQ ID NO: 1219 - DNA, 34 bp, Artificial
  synthetic oligonucleotide
  modified_base (16)..(16): c or methylated C nucleotide
  modified_base (21)..(21): c or methylated C nucleotide
gcgcgggctgctgggcggggcgacctgggatccc

SEQ ID NO: 1220 - DNA, 34 bp, Artificial
  synthetic oligonucleotide
  modified_base (19)..(19): c or methylated C nucleotide
  modified_base (24)..(24): c or methylated C nucleotide
agggcgcgggctgctgggcggggcgacctgggat

SEQ ID NO: 1221 - DNA, 33 bp, Artificial
  synthetic oligonucleotide
  modified_base (1)..(1): c or methylated C nucleotide
  modified_base (6)..(6): c or methylated C nucleotide
  modified_base (28)..(28): c or methylated C nucleotide
cggggcgacctgggatcccaggcctggcggcgc

SEQ ID NO: 1222 - DNA, 33 bp, Artificial
  synthetic oligonucleotide
  modified_base (3)..(3): c or methylated C nucleotide
  modified_base (25)..(25): c or methylated C nucleotide
ggcgacctgggatcccaggcctggcggcgcgag

SEQ ID NO: 1223 - DNA, 33 bp, Artificial
  synthetic oligonucleotide
  modified_base (22)..(22): c or methylated C nucleotide
gacctgggatcccaggcctggcggcgcgagccg

SEQ ID NO: 1224 - DNA, 33 bp, Artificial
  synthetic oligonucleotide
  modified_base (19)..(19): c or methylated C nucleotide
ctgggatcccaggcctggcggcgcgagccgggc

SEQ ID NO: 1225 - DNA, 33 bp, Artificial
  synthetic oligonucleotide
  modified_base (16)..(16): c or methylated C nucleotide
ggatcccaggcctggcggcgcgagccgggcacc

SEQ ID NO: 1226 - DNA, 31 bp, Artificial
  synthetic oligonucleotide
  modified_base (2)..(2): c or methylated C nucleotide
  modified_base (7)..(7): c or methylated C nucleotide
  modified_base (29)..(29): c or methylated C nucleotide
gcggggcgacctgggatcccaggcctggcgg

SEQ ID NO: 1227 - DNA, 29 bp, Artificial
  synthetic oligonucleotide
  modified_base (5)..(5): c or methylated C nucleotide
  modified_base (27)..(27): c or methylated C nucleotide
ggggcgacctgggatcccaggcctggcgg

SEQ ID NO: 1228 - DNA, 27 bp, Artificial
  synthetic oligonucleotide
  modified_base (3)..(3): c or methylated C nucleotide
  modified_base (25)..(25): c or methylated C nucleotide
ggcgacctgggatcccaggcctggcgg

SEQ ID NO: 1229 - DNA, 25 bp, Artificial
  synthetic oligonucleotide
  modified_base (1)..(1): c or methylated C nucleotide
  modified_base (23)..(23): c or methylated C nucleotide
cgacctgggatcccaggcctggcgg

SEQ ID NO: 1230 - DNA, 23 bp, Artificial
  synthetic oligonucleotide
  modified_base (21)..(21): c or methylated C nucleotide
acctgggatcccaggcctggcgg

SEQ ID NO: 1231 - DNA, 21 bp, Artificial
  synthetic oligonucleotide
  modified_base (19)..(19): c or methylated C nucleotide
ctgggatcccaggcctggcgg

SEQ ID NO: 1232 - DNA, 19 bp, Artificial
  synthetic oligonucleotide
  modified_base (17)..(17): c or methylated C nucleotide
gggatcccaggcctggcgg

SEQ ID NO: 1233 - DNA, 17 bp, Artificial
  synthetic oligonucleotide
  modified_base (15)..(15): c or methylated C nucleotide
gatcccaggcctggcgg

SEQ ID NO: 1234 - DNA, 15 bp, Artificial
  synthetic oligonucleotide
  modified_base (13)..(13): c or methylated C nucleotide
tcccaggcctggcgg

SEQ ID NO: 1235 - DNA, 14 bp, Artificial
  synthetic oligonucleotide
  modified_base (12)..(12): c or methylated C nucleotide
cccaggcctggcgg

SEQ ID NO: 1236 - DNA, 31 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctggc

SEQ ID NO: 1237 - DNA, 29 bp, Artificial
  synthetic oligonucleotide
  modified_base (4)..(4): c or methylated C nucleotide
  modified_base (9)..(9): c or methylated C nucleotide
gggcggggcgacctgggatcccaggcctg

SEQ ID NO: 1238 - DNA, 27 bp, Artificial
  synthetic oligonucleotide
  modified_base (4)..(4): c or methylated C nucleotide
  modified_base (9)..(9): c or methylated C nucleotide
gggcggggcgacctgggatcccaggcc

SEQ ID NO: 1239 - DNA, 25 bp, Artificial
  synthetic oligonucleotide
  modified_base (4)..(4): c or methylated C nucleotide
  modified_base (9)..(9): c or methylated C nucleotide
gggcggggcgacctgggatcccagg

SEQ ID NO: 1240 - DNA, 24 bp, Artificial
  synthetic oligonucleotide
  modified_base (4)..(4): c or methylated C nucleotide
  modified_base (9)..(9): c or methylated C nucleotide
gggcggggcgacctgggatcccag

SEQ ID NO: 1241 - DNA, 22 bp, Artificial
  synthetic oligonucleotide
  modified_base (4)..(4): c or methylated C nucleotide
  modified_base (9)..(9): c or methylated C nucleotide
gggcggggcgacctgggatccc

SEQ ID NO: 1242 - DNA, 20 bp, Artificial
  synthetic oligonucleotide
  modified_base (4)..(4): c or methylated C nucleotide
  modified_base (9)..(9): c or methylated C nucleotide
gggcggggcgacctgggatc

SEQ ID NO: 1243 - DNA, 18 bp, Artificial
  synthetic oligonucleotide
  modified_base (4)..(4): c or methylated C nucleotide
  modified_base (9)..(9): c or methylated C nucleotide
gggcggggcgacctggga

SEQ ID NO: 1244 - DNA, 16 bp, Artificial
  synthetic oligonucleotide
  modified_base (4)..(4): c or methylated C nucleotide
  modified_base (9)..(9): c or methylated C nucleotide
gggcggggcgacctgg

SEQ ID NO: 1245 - DNA, 15 bp, Artificial
  synthetic oligonucleotide
  modified_base (4)..(4): c or methylated C nucleotide
  modified_base (9)..(9): c or methylated C nucleotide
gggcggggcgacctg

SEQ ID NO: 1246 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctggcatcccaggcctggcgg

SEQ ID NO: 1247 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgatctgggatcccaggcctggcgg

SEQ ID NO: 1248 - DNA, 33 bp, Artificial
  synthetic oligonucleotide
  modified_base (4)..(4): c or methylated C nucleotide
  modified_base (9)..(9): c or methylated C nucleotide
  modified_base (31)..(31): c or methylated C nucleotide
gggcggggcgacctgggatcccaggcctgccgg

SEQ ID NO: 1249 - DNA, 2026 bp, Artificial
  synthetic oligonucleotide
  misc_feature (1)..(2026): Nucleic acid sequence of part of the bcl-2 gene 59140256-59138244 (Location on Chromosome 18, -strand)
aacatagcaaaagccatctcttaaaaaaaaaaaaaaaaggccaactaagtaaaaattaaaaaaatcataatttggtgtgcttttctggctttttaaagaatgttttgattttagagtaggaatgagacaaaataaagatgtcaggcagggcacagtggctcatgtctgtaatcccagcactttgggaggctgaggcaggcggataacgaggtcaggagttcgagaccagcctggccagtatggcgaaaccccgtctctactaaaaatacaaaaattagcagagcgtagtggcgtgcacgtgtaatcccagctactcaggaggctgaggcagaattgcttgagcctgggaggcagaggttgcagtgagctgagatcgcaccactgcacaccagcctccaagatacaacagagcaagactctgtctcaaaaaaaaaaaaaaagtcatagcatatttgtacacattgtagtactcatttgtcatctttcttgaccccaataatccagtgtccctatatatttgcactcgagccctattaagtaagccgctgtgcttctagaagacctttttcttttcttggtgctttgtcaaagactcttggagataaaaatacacacgtgcaacttgtttgtcctcttgtccttttttgctaggggctattcatgctgattaatttaaaactgtctgcttgcgcgtacacacgtctgcgagtgtgaatgtgtatgtgtgtatctatgtacctcatttgagaaagtgcggccaactaggattggctacgaggcaaaggtggagacctttaggagcccacccaccccagcgttaggacggtgggcctgaaagttactatatggaagtcctcatcgtgtagcactaaaccagtgtaaaaggtgttagggacagagggaaaacattgacttaaactgtcgtaaagcccttgataaaccccttccctggagcgctgagttctgcatggcctgggccacggactaggtgttcaggtggacacgggcggggatgcgcgtgcgtgtgtagtgcgcggacacctaggaagctacttgaaagtaaacaccacgctcggggcgtccctagacattgcttaaaacgtgcagagtcacctgtcttcacagcagggcagcgctgaggtcccactgctgggggcggtggggggcggcattggcctgggtcttcccccggcggccgagcgccggtaacacaacgtgtgtgtgtgtaggcgcgtgtacacactctcatacacggctagaaagggtccaggcgacacacacactcccacatacacggctagaaaaggtccaggcgagacacacacacacacacacacacacacacacactccacacacactcacacggccagaaagggtccaggcggttcccggcgcttttccagcccttgttttcatggcgcaccctcccgccagccgcccccctccgcactccgtcgtccgcccggcccggccgcgtgcggttccccgggagcccccaccccgtcgcggaccccagcgaccaccaagtccgcacgcggcctgccgcaggcctgagcagaaggccccgcgcacacccaccgcgccgcggccgcgcgggaggcctgtgccgcccgcgccacccactggccgggccccgcgggcgcagcggagcgggcgggtggccggcccggacgcgccctccccggccgcggccccgcgcgccatgtgcccccggcgggacgcgccactcccgggcctgccgcggcgcctttaacccgggccagggagcggggcggagggggcggtcgggtggctcagaggagggctctttctttcttctttttttgaatgaaccgtgtgacgttacgcacaggaaaccggtcgggctgtgcagagaatgaagtaagaggacaggcaccacagccccgctcccgcccccttcctcccgcgcccgcccctccgcgccgcctgcccgcccgcccgccgcgctcccgcccgccgctctccgtggccccgccgcgctgccgccgccgccgctgccagcg

SEQ ID NO: 1250 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtg

SEQ ID NO: 1251 - DNA, 24 bp, Artificial
  synthetic oligonucleotide
  misc_feature (1)..(24): 59139245-59139268 (Location on Chromosome 18)
cacgcacgcgcatccccgcccgtg

SEQ ID NO: 1252 - DNA, 23 bp, Artificial
  synthetic oligonucleotide
  modified_base (4)..(4): c or methylated C nucleotide
  modified_base (10)..(10): c or methylated C nucleotide
  modified_base (18)..(18): c or methylated C nucleotide
  modified_base (20)..(20): c or methylated C nucleotide
actcgcagacgtgtgtacgcgca

SEQ ID NO: 1253 - DNA, 23 bp, Artificial
  synthetic oligonucleotide
  misc_feature (1)..(23): 59139560-59139582 (Location on Chromosome 18)
actcgcagacgtgtgtacgcgca

SEQ ID NO: 1254 - DNA, 60 bp, Artificial
  synthetic oligonucleotide
  misc_feature (1)..(60): Nucleic acid sequence of part of the bcl-2 gene, Secondary promoter 59136900-59136959 (Location on Chromosome 18, -strand)
cgggggccaacggcacctctcgccccagctcccaccccacggcccccagagaaagaagag

SEQ ID NO: 1255 - DNA, 34 bp, Artificial
  synthetic oligonucleotide
  misc_feature (1)..(34): FL989 breakpoint  59139078-59139045 (Location on Chromosome 18, -strand)
gcggccgagcgccggtaacacaacgtgtgtgtgt

SEQ ID NO: 1256 - DNA, 15 bp, Artificial
  synthetic oligonucleotide
  misc_feature (1)..(15): BCL2/IGH breakpoint 59139200-59139186 (Location on Chromosome 18, -strand)
acaccacgctcgggg

SEQ ID NO: 1257 - DNA, 17 bp, Artificial
  synthetic oligonucleotide
  misc_feature (1)..(17): BCL2/IGH breakpoint  9138798-59138781 (Location on Chromosome 18, -strand)
cccggccgcgtgcggtt

SEQ ID NO: 1258 - DNA, 15 bp, Artificial
  synthetic oligonucleotide
  misc_feature (1)..(15): BCL2/IGH breakpoint 59137579-59137565(Location on Chromosome 18, -strand)
agcagaagtctggga

SEQ ID NO: 1259 - DNA, 14 bp, Artificial
  synthetic oligonucleotide
  misc_feature (1)..(14): BCL2/IGH breakpoint 59137255-59137241 (Location on Chromosome 18, -strand)
tacttgtagtgtgt

SEQ ID NO: 1260 - DNA, 15 bp, Artificial
  synthetic oligonucleotide
  misc_feature (1)..(15): BCL2/IGLkappa breakpoint 59139029-59139015 (Location on Chromosome 18, -strand)
gtacacactctcata

SEQ ID NO: 1261 - DNA, 15 bp, Artificial
  synthetic oligonucleotide
  misc_feature (1)..(15): BCL2/IGLkappa breakpoint 59138914-59138899 (Location on Chromosome 18, -strand)
acacactccacacac

SEQ ID NO: 1262 - DNA, 15 bp, Artificial
  synthetic oligonucleotide
  misc_feature (1)..(15): BCL2/IGLkappa breakpoint 59138934-59138919 (Location on Chromosome 18, -strand)
acacggccagaaagg

SEQ ID NO: 1263 - DNA, 14 bp, Artificial
  synthetic oligonucleotide
  misc_feature (1)..(14): BCL2/IGLkappa breakpoint 59137928-59137915 (Location on Chromosome 18, -strand)
ggcgggccaggcgc

SEQ ID NO: 1264 - DNA, 15 bp, Artificial
  synthetic oligonucleotide
  misc_feature (1)..(15): BCL2/IGLlamba breakpoint 59138426-59138411 (Location on Chromosome 18, -strand)
tgtgacgttacgcac

SEQ ID NO: 1265 - DNA, 16 bp, Artificial
  synthetic oligonucleotide
  misc_feature (1)..(16): BCL2/IGLlamba breakpoint 59138213-59138198 (Location on Chromosome 18, -strand)
ctgccggcggccgtca

SEQ ID NO: 1266 - DNA, 15 bp, Artificial
  synthetic oligonucleotide
  misc_feature (1)..(15): BCL2/IGLlamba breakpoint 59137963-59137948 (Location on Chromosome 18, -strand)
acacacagcgcgggc

SEQ ID NO: 1267 - DNA, 26 bp, Artificial
  synthetic oligonucleotide
  misc_feature (1)..(26): NBL19 59139326-59139349 (Location on Chromosome 18)
aaggggtttatcaagggctttacgac

SEQ ID NO: 1268 - DNA, 20 bp, Artificial
  synthetic oligonucleotide
  misc_feature (1)..(20): NBL20 59139271-59139291 (Location on Chromosome 18)
cacctgaacacctagtccgt

SEQ ID NO: 1269 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggg

SEQ ID NO: 1270 - DNA, 26 bp, Artificial
  synthetic oligonucleotide
  misc_feature (1)..(26): BL6 59138610-59138635 (Location on Chromosome 18)
cccgcccgctccgctgcgcccgcggg

SEQ ID NO: 1271 - DNA, 28 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
  modified_base (23)..(23): c or methylated C nucleotide
acatggcgcgcggggccgcggccgggga

SEQ ID NO: 1272 - DNA, 28 bp, Artificial
  synthetic oligonucleotide
  misc_feature (1)..(28): BL8a 59138562-59138589 (Location on Chromosome 18)
acatggcgcgcggggccgcggccgggga

SEQ ID NO: 1273 - DNA, 24 bp, Artificial
  synthetic oligonucleotide
  misc_feature (1)..(24): NBL1 59139724-59139747 (Location on Chromosome 18)
gcggcttacttaatagggctcgag

SEQ ID NO: 1274 - DNA, 28 bp, Artificial
  synthetic oligonucleotide
cctcgtagccaatcctagttggccgcac

SEQ ID NO: 1275 - DNA, 24 bp, Artificial
  synthetic oligonucleotide
  misc_feature (1)..(24): 59139436-59139459 (Location on Chromosome 18)
caggcccaccgtcctaacgctggg

SEQ ID NO: 1276 - DNA, 25 bp, Artificial
  synthetic oligonucleotide
  misc_feature (1)..(25): NBL4 59139181-59139205 (Location on Chromosome 18)
gtctagggacgccccgagcgtggtg

SEQ ID NO: 1277 - DNA, 26 bp, Artificial
  synthetic oligonucleotide
  misc_feature (1)..(26): 59139015-59139040 (Location on Chromosome 18)
ccgtgtatgagagtgtgtacacgcgc

SEQ ID NO: 1278 - DNA, 24 bp, Artificial
  synthetic oligonucleotide
  misc_feature (1)..(22): NBL7a 59138881-59138904 (Location on Chromosome 18)
  misc_feature (1)..(24): NBL7a 59138881-59138904 (Location on Chromosome 18)
aaccgcctggaccctttctggccg

SEQ ID NO: 1279 - DNA, 31 bp, Artificial
  synthetic oligonucleotide
  misc_feature (1)..(30): NBL8a 59138810-59138840 (Location on Chromosome 18)
  misc_feature (1)..(31): NBL8a 59138810-59138840 (Location on Chromosome 18)
acgacggagtgcggaggggggcggctggcgg

SEQ ID NO: 1280 - DNA, 23 bp, Artificial
  synthetic oligonucleotide
  misc_feature (1)..(23): NBL9 59138759-59138781 (Location on Chromosome 18)
ccgcgacggggtgggggctcccg

SEQ ID NO: 1281 - DNA, 35 bp, Artificial
  synthetic oligonucleotide
  misc_feature (1)..(35): NBL11a 59138639-59138673 (Location on Chromosome 18)
cggccagtgggtggcgcgggcggcacaggcctccc

SEQ ID NO: 1282 - DNA, 25 bp, Artificial
  synthetic oligonucleotide
  misc_feature (1)..(25): NBL12a 59138521-59138545 (Location on Chromosome 18)
gcgccgcggcaggcccgggagtggc

SEQ ID NO: 1283 - DNA, 34 bp, Artificial
  synthetic oligonucleotide
  misc_feature (1)..(34): NBL14 59138402-59138435 (Location on Chromosome 18)
gcccgaccggtttcctgtgcgtaacgtcacacgg

SEQ ID NO: 1284 - DNA, 30 bp, Artificial
  synthetic oligonucleotide
  misc_feature (1)..(30): NBL15 59139630-59139659 (Location on Chromosome 18)
ggacaagaggacaaacaagttgcacgtgtg

SEQ ID NO: 1285 - DNA, 30 bp, Artificial
  synthetic oligonucleotide
  misc_feature (1)..(30): NBL16 59139393-59139422 (Location on Chromosome 18)
ctggtttagtgctacacgatgaggacttcc

SEQ ID NO: 1286 - DNA, 24 bp, Artificial
  synthetic oligonucleotide
  misc_feature (1)..(24): NBL5a 59139102-59139125 (Location on Chromosome 18)
cgccccccaccgcccccagcagtg

SEQ ID NO: 1287 - DNA, 34 bp, Artificial
  synthetic oligonucleotide
cccgaccgccccctccgccccgctccctggcccg

SEQ ID NO: 1288 - DNA, 24 bp, Artificial
  synthetic oligonucleotide
cacgggcggggatgcgcgtgcgtg

SEQ ID NO: 1289 - DNA, 25 bp, Artificial
  synthetic oligonucleotide
  modified_base (4)..(4): c or methylated C nucleotide
  modified_base (8)..(8): c or methylated C nucleotide
  modified_base (10)..(10): c or methylated C nucleotide
  modified_base (18)..(18): c or methylated C nucleotide
  modified_base (22)..(22): c or methylated C nucleotide
acacgcacgcgcatccccgcccgtg

SEQ ID NO: 1290 - DNA, 25 bp, Artificial
  synthetic oligonucleotide
acacgcacgcgcatccccgcccgtg

SEQ ID NO: 1291 - DNA, 26 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
  modified_base (19)..(19): c or methylated C nucleotide
  modified_base (23)..(23): c or methylated C nucleotide
cacacgcacgcgcatccccgcccgtg

SEQ ID NO: 1292 - DNA, 26 bp, Artificial
  synthetic oligonucleotide
cacacgcacgcgcatccccgcccgtg

SEQ ID NO: 1293 - DNA, 27 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgcccgtg

SEQ ID NO: 1294 - DNA, 27 bp, Artificial
  synthetic oligonucleotide
acacacgcacgcgcatccccgcccgtg

SEQ ID NO: 1295 - DNA, 28 bp, Artificial
  synthetic oligonucleotide
  modified_base (7)..(7): c or methylated C nucleotide
  modified_base (11)..(11): c or methylated C nucleotide
  modified_base (13)..(13): c or methylated C nucleotide
  modified_base (21)..(21): c or methylated C nucleotide
  modified_base (25)..(25): c or methylated C nucleotide
tacacacgcacgcgcatccccgcccgtg

SEQ ID NO: 1296 - DNA, 28 bp, Artificial
  synthetic oligonucleotide
tacacacgcacgcgcatccccgcccgtg

SEQ ID NO: 1297 - DNA, 29 bp, Artificial
  synthetic oligonucleotide
  modified_base (8)..(8): c or methylated C nucleotide
  modified_base (12)..(12): c or methylated C nucleotide
  modified_base (14)..(14): c or methylated C nucleotide
  modified_base (22)..(22): c or methylated C nucleotide
  modified_base (26)..(26): c or methylated C nucleotide
ctacacacgcacgcgcatccccgcccgtg

SEQ ID NO: 1298 - DNA, 29 bp, Artificial
  synthetic oligonucleotide
ctacacacgcacgcgcatccccgcccgtg

SEQ ID NO: 1299 - DNA, 25 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgt

SEQ ID NO: 1300 - DNA, 25 bp, Artificial
  synthetic oligonucleotide
cacgcacgcgcatccccgcccgtgt

SEQ ID NO: 1301 - DNA, 26 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtc

SEQ ID NO: 1302 - DNA, 26 bp, Artificial
  synthetic oligonucleotide
cacgcacgcgcatccccgcccgtgtc

SEQ ID NO: 1303 - DNA, 27 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtcc

SEQ ID NO: 1304 - DNA, 27 bp, Artificial
  synthetic oligonucleotide
cacgcacgcgcatccccgcccgtgtcc

SEQ ID NO: 1305 - DNA, 28 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtcca

SEQ ID NO: 1306 - DNA, 28 bp, Artificial
  synthetic oligonucleotide
cacgcacgcgcatccccgcccgtgtcca

SEQ ID NO: 1307 - DNA, 29 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccgtgtccac

SEQ ID NO: 1308 - DNA, 29 bp, Artificial
  synthetic oligonucleotide
cacgcacgcgcatccccgcccgtgtccac

SEQ ID NO: 1309 - DNA, 26 bp, Artificial
  synthetic oligonucleotide
  modified_base (4)..(4): c or methylated C nucleotide
  modified_base (8)..(8): c or methylated C nucleotide
  modified_base (10)..(10): c or methylated C nucleotide
  modified_base (18)..(18): c or methylated C nucleotide
  modified_base (22)..(22): c or methylated C nucleotide
acacgcacgcgcatccccgcccgtgt

SEQ ID NO: 1310 - DNA, 26 bp, Artificial
  synthetic oligonucleotide
acacgcacgcgcatccccgcccgtgt

SEQ ID NO: 1311 - DNA, 28 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
  modified_base (19)..(19): c or methylated C nucleotide
  modified_base (23)..(23): c or methylated C nucleotide
cacacgcacgcgcatccccgcccgtgtc

SEQ ID NO: 1312 - DNA, 28 bp, Artificial
  synthetic oligonucleotide
cacacgcacgcgcatccccgcccgtgtc

SEQ ID NO: 1313 - DNA, 30 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgcccgtgtcc

SEQ ID NO: 1314 - DNA, 30 bp, Artificial; identical to SEQ ID NO: 1313
  synthetic oligonucleotide

SEQ ID NO: 1315 - DNA, 32 bp, Artificial
  synthetic oligonucleotide
  modified_base (7)..(7): c or methylated C nucleotide
  modified_base (11)..(11): c or methylated C nucleotide
  modified_base (13)..(13): c or methylated C nucleotide
  modified_base (21)..(21): c or methylated C nucleotide
  modified_base (25)..(25): c or methylated C nucleotide
tacacacgcacgcgcatccccgcccgtgtcca

SEQ ID NO: 1316 - DNA, 32 bp, Artificial; identical to SEQ ID NO: 1315
  synthetic oligonucleotide

SEQ ID NO: 1317 - DNA, 34 bp, Artificial
  synthetic oligonucleotide
  modified_base (8)..(8): c or methylated C nucleotide
  modified_base (12)..(12): c or methylated C nucleotide
  modified_base (14)..(14): c or methylated C nucleotide
  modified_base (22)..(22): c or methylated C nucleotide
  modified_base (26)..(26): c or methylated C nucleotide
ctacacacgcacgcgcatccccgcccgtgtccac

SEQ ID NO: 1318 - DNA, 34 bp, Artificial; identical to SEQ ID NO: 1317
  synthetic oligonucleotide

SEQ ID NO: 1319 - DNA, 24 bp, Artificial
  synthetic oligonucleotide
  modified_base (6)..(6): c or methylated C nucleotide
  modified_base (10)..(10): c or methylated C nucleotide
  modified_base (12)..(12): c or methylated C nucleotide
  modified_base (20)..(20): c or methylated C nucleotide
  modified_base (24)..(24): c or methylated C nucleotide
acacacgcacgcgcatccccgccc

SEQ ID NO: 1320 - DNA, 24 bp, Artificial
  synthetic oligonucleotide
acacacgcacgcgcatccccgccc

SEQ ID NO: 1321 - DNA, 24 bp, Artificial
  synthetic oligonucleotide
  modified_base (9)..(9): c or methylated C nucleotide
  modified_base (13)..(13): c or methylated C nucleotide
  modified_base (15)..(15): c or methylated C nucleotide
  modified_base (23)..(23): c or methylated C nucleotide
actacacacgcacgcgcatccccg

SEQ ID NO: 1322 - DNA, 24 bp, Artificial
  synthetic oligonucleotide
actacacacgcacgcgcatccccg

SEQ ID NO: 1323 - DNA, 24 bp, Artificial
  synthetic oligonucleotide
  modified_base (12)..(12): c or methylated C nucleotide
  modified_base (16)..(16): c or methylated C nucleotide
  modified_base (18)..(18): c or methylated C nucleotide
cgcactacacacgcacgcgcatcc

SEQ ID NO: 1324 - DNA, 24 bp, Artificial
  synthetic oligonucleotide
cgcactacacacgcacgcgcatcc

SEQ ID NO: 1325 - DNA, 24 bp, Artificial
  synthetic oligonucleotide
  modified_base (15)..(15): c or methylated C nucleotide
  modified_base (19)..(19): c or methylated C nucleotide
  modified_base (21)..(21): c or methylated C nucleotide
ccgcgcactacacacgcacgcgca

SEQ ID NO: 1326 - DNA, 24 bp, Artificial
  synthetic oligonucleotide
ccgcgcactacacacgcacgcgca

SEQ ID NO: 1327 - DNA, 24 bp, Artificial
  synthetic oligonucleotide
  modified_base (18)..(18): c or methylated C nucleotide
  modified_base (22)..(22): c or methylated C nucleotide
  modified_base (24)..(24): c or methylated C nucleotide
tgtccgcgcactacacacgcacgc

SEQ ID NO: 1328 - DNA, 24 bp, Artificial
  synthetic oligonucleotide
tgtccgcgcactacacacgcacgc

SEQ ID NO: 1329 - DNA, 24 bp, Artificial
  synthetic oligonucleotide
  modified_base (4)..(4): c or methylated C nucleotide
  modified_base (6)..(6): c or methylated C nucleotide
  modified_base (14)..(14): c or methylated C nucleotide
  modified_base (18)..(18): c or methylated C nucleotide
gcacgcgcatccccgcccgtgtcc

SEQ ID NO: 1330 - DNA, 24 bp, Artificial
  synthetic oligonucleotide
gcacgcgcatccccgcccgtgtcc

SEQ ID NO: 1331 - DNA, 24 bp, Artificial
  synthetic oligonucleotide
  modified_base (1)..(1): c or methylated C nucleotide
  modified_base (3)..(3): c or methylated C nucleotide
  modified_base (11)..(11): c or methylated C nucleotide
  modified_base (15)..(15): c or methylated C nucleotide
cgcgcatccccgcccgtgtccacc

SEQ ID NO: 1332 - DNA, 24 bp, Artificial
  synthetic oligonucleotide
cgcgcatccccgcccgtgtccacc

SEQ ID NO: 1333 - DNA, 24 bp, Artificial
  synthetic oligonucleotide
  modified_base (8)..(8): c or methylated C nucleotide
  modified_base (12)..(12): c or methylated C nucleotide
gcatccccgcccgtgtccacctga

SEQ ID NO: 1334 - DNA, 24 bp, Artificial
  synthetic oligonucleotide
gcatccccgcccgtgtccacctga

SEQ ID NO: 1335 - DNA, 24 bp, Artificial
  synthetic oligonucleotide
  modified_base (5)..(5): c or methylated C nucleotide
  modified_base (9)..(9): c or methylated C nucleotide
tccccgcccgtgtccacctgaaca

SEQ ID NO: 1336 - DNA, 24 bp, Artificial
  synthetic oligonucleotide
tccccgcccgtgtccacctgaaca

SEQ ID NO: 1337 - DNA, 24 bp, Artificial
  synthetic oligonucleotide
  modified_base (2)..(2): c or methylated C nucleotide
  modified_base (6)..(6): c or methylated C nucleotide
ccgcccgtgtccacctgaacacct

SEQ ID NO: 1338 - DNA, 24 bp, Artificial
  synthetic oligonucleotide
ccgcccgtgtccacctgaacacct

SEQ ID NO: 1339 - DNA, 22 bp, Artificial
  synthetic oligonucleotide
  modified_base (1)..(1): c or methylated C nucleotide
  modified_base (5)..(5): c or methylated C nucleotide
  modified_base (7)..(7): c or methylated C nucleotide
  modified_base (15)..(15): c or methylated C nucleotide
  modified_base (19)..(19): c or methylated C nucleotide
cgcacgcgcatccccgcccgtg

SEQ ID NO: 1340 - DNA, 22 bp, Artificial
  synthetic oligonucleotide
cgcacgcgcatccccgcccgtg

SEQ ID NO: 1341 - DNA, 20 bp, Artificial
  synthetic oligonucleotide
  modified_base (3)..(3): c or methylated C nucleotide
  modified_base (5)..(5): c or methylated C nucleotide
  modified_base (13)..(13): c or methylated C nucleotide
  modified_base (17)..(17): c or methylated C nucleotide
cacgcgcatccccgcccgtg

SEQ ID NO: 1342 - DNA, 20 bp, Artificial
  synthetic oligonucleotide
cacgcgcatccccgcccgtg

SEQ ID NO: 1343 - DNA, 18 bp, Artificial
  synthetic oligonucleotide
  modified_base (1)..(1): c or methylated C nucleotide
  modified_base (3)..(3): c or methylated C nucleotide
  modified_base (11)..(11): c or methylated C nucleotide
  modified_base (15)..(15): c or methylated C nucleotide
cgcgcatccccgcccgtg

SEQ ID NO: 1344 - DNA, 18 bp, Artificial
  synthetic oligonucleotide
cgcgcatccccgcccgtg

SEQ ID NO: 1345 - DNA, 16 bp, Artificial
  synthetic oligonucleotide
  modified_base (1)..(1): c or methylated C nucleotide
  modified_base (9)..(9): c or methylated C nucleotide
  modified_base (13)..(13): c or methylated C nucleotide
cgcatccccgcccgtg

SEQ ID NO: 1346 - DNA, 16 bp, Artificial
  synthetic oligonucleotide
cgcatccccgcccgtg

SEQ ID NO: 1347 - DNA, 15 bp, Artificial
  synthetic oligonucleotide
  modified_base (8)..(8): c or methylated C nucleotide
  modified_base (12)..(12): c or methylated C nucleotide
gcatccccgcccgtg

SEQ ID NO: 1348 - DNA, 15 bp, Artificial
  synthetic oligonucleotide
gcatccccgcccgtg

SEQ ID NO: 1349 - DNA, 22 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgcccg

SEQ ID NO: 1350 - DNA, 22 bp, Artificial
  synthetic oligonucleotide
cacgcacgcgcatccccgcccg

SEQ ID NO: 1351 - DNA, 20 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
cacgcacgcgcatccccgcc

SEQ ID NO: 1352 - DNA, 20 bp, Artificial
  synthetic oligonucleotide
cacgcacgcgcatccccgcc

SEQ ID NO: 1353 - DNA, 18 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
cacgcacgcgcatccccg

SEQ ID NO: 1354 - DNA, 18 bp, Artificial
  synthetic oligonucleotide
cacgcacgcgcatccccg

SEQ ID NO: 1355 - DNA, 16 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
cacgcacgcgcatccc

SEQ ID NO: 1356 - DNA, 16 bp, Artificial
  synthetic oligonucleotide
cacgcacgcgcatccc

SEQ ID NO: 1357 - DNA, 15 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
cacgcacgcgcatcc

SEQ ID NO: 1358 - DNA, 15 bp, Artificial
  synthetic oligonucleotide
cacgcacgcgcatcc

SEQ ID NO: 1359 - DNA, 25 bp, Artificial
  synthetic oligonucleotide
ccgcgggcgcagcggagcgggcggg

SEQ ID NO: 1360 - DNA, 27 bp, Artificial
  synthetic oligonucleotide
  modified_base (4)..(4): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (22)..(22): c or methylated C nucleotide
  modified_base (24)..(24): c or methylated C nucleotide
acccgcccgctccgctgcgcccgcggg

SEQ ID NO: 1361 - DNA, 27 bp, Artificial
  synthetic oligonucleotide
acccgcccgctccgctgcgcccgcggg

SEQ ID NO: 1362 - DNA, 28 bp, Artificial
  synthetic oligonucleotide
  modified_base (5)..(5): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (23)..(23): c or methylated C nucleotide
  modified_base (25)..(25): c or methylated C nucleotide
cacccgcccgctccgctgcgcccgcggg

SEQ ID NO: 1363 - DNA, 28 bp, Artificial
  synthetic oligonucleotide
cacccgcccgctccgctgcgcccgcggg

SEQ ID NO: 1364 - DNA, 29 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgcggg

SEQ ID NO: 1365 - DNA, 29 bp, Artificial
  synthetic oligonucleotide
ccacccgcccgctccgctgcgcccgcggg

SEQ ID NO: 1366 - DNA, 30 bp, Artificial
  synthetic oligonucleotide
  modified_base (7)..(7): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (25)..(25): c or methylated C nucleotide
  modified_base (27)..(27): c or methylated C nucleotide
gccacccgcccgctccgctgcgcccgcggg

SEQ ID NO: 1367 - DNA, 30 bp, Artificial; identical to SEQ ID NO: 1366
  synthetic oligonucleotide

SEQ ID NO: 1368 - DNA, 31 bp, Artificial
  synthetic oligonucleotide
  modified_base (8)..(8): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (26)..(26): c or methylated C nucleotide
  modified_base (28)..(28): c or methylated C nucleotide
ggccacccgcccgctccgctgcgcccgcggg

SEQ ID NO: 1369 - DNA, 31 bp, Artificial; identical to SEQ ID NO: 1368
  synthetic oligonucleotide

SEQ ID NO: 1370 - DNA, 27 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcgggg

SEQ ID NO: 1371 - DNA, 27 bp, Artificial
  synthetic oligonucleotide
cccgcccgctccgctgcgcccgcgggg

SEQ ID NO: 1372 - DNA, 28 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggc

SEQ ID NO: 1373 - DNA, 28 bp, Artificial
  synthetic oligonucleotide
cccgcccgctccgctgcgcccgcggggc

SEQ ID NO: 1374 - DNA, 29 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggcc

SEQ ID NO: 1375 - DNA, 29 bp, Artificial
  synthetic oligonucleotide
cccgcccgctccgctgcgcccgcggggcc

SEQ ID NO: 1376 - DNA, 30 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggccc

SEQ ID NO: 1377 - DNA, 30 bp, Artificial; identical to SEQ ID NO: 1376
  synthetic oligonucleotide

SEQ ID NO: 1378 - DNA, 31 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcggggcccg

SEQ ID NO: 1379 - DNA, 31 bp, Artificial; identical to SEQ ID NO: 1378
  synthetic oligonucleotide

SEQ ID NO: 1380 - DNA, 28 bp, Artificial
  synthetic oligonucleotide
  modified_base (4)..(4): c or methylated C nucleotide
  modified_base (8)..(8): c or methylated C nucleotide
  modified_base (13)..(13): c or methylated C nucleotide
  modified_base (18)..(18): c or methylated C nucleotide
  modified_base (22)..(22): c or methylated C nucleotide
  modified_base (24)..(24): c or methylated C nucleotide
acccgcccgctccgctgcgcccgcgggg

SEQ ID NO: 1381 - DNA, 28 bp, Artificial
  synthetic oligonucleotide
acccgcccgctccgctgcgcccgcgggg

SEQ ID NO: 1382 - DNA, 30 bp, Artificial
  synthetic oligonucleotide
  modified_base (5)..(5): c or methylated C nucleotide
  modified_base (9)..(9): c or methylated C nucleotide
  modified_base (14)..(14): c or methylated C nucleotide
  modified_base (19)..(19): c or methylated C nucleotide
  modified_base (23)..(23): c or methylated C nucleotide
  modified_base (25)..(25): c or methylated C nucleotide
cacccgcccgctccgctgcgcccgcggggc

SEQ ID NO: 1383 - DNA, 30 bp, Artificial; identical to SEQ ID NO: 1382
  synthetic oligonucleotide

SEQ ID NO: 1384 - DNA, 32 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgcggggcc

SEQ ID NO: 1385 - DNA, 32 bp, Artificial; identical to SEQ ID NO: 1384
  synthetic oligonucleotide

SEQ ID NO: 1386 - DNA, 34 bp, Artificial
  synthetic oligonucleotide
  modified_base (7)..(7): c or methylated C nucleotide
  modified_base (11)..(11): c or methylated C nucleotide
  modified_base (16)..(16): c or methylated C nucleotide
  modified_base (21)..(21): c or methylated C nucleotide
  modified_base (25)..(25): c or methylated C nucleotide
  modified_base (27)..(27): c or methylated C nucleotide
gccacccgcccgctccgctgcgcccgcggggccc

SEQ ID NO: 1387 - DNA, 34 bp, Artificial; identical to SEQ ID NO: 1386
  synthetic oligonucleotide

SEQ ID NO: 1388 - DNA, 36 bp, Artificial
  synthetic oligonucleotide
  modified_base (8)..(8): c or methylated C nucleotide
  modified_base (12)..(12): c or methylated C nucleotide
  modified_base (17)..(17): c or methylated C nucleotide
  modified_base (22)..(22): c or methylated C nucleotide
  modified_base (26)..(26): c or methylated C nucleotide
  modified_base (28)..(28): c or methylated C nucleotide
ggccacccgcccgctccgctgcgcccgcggggcccg

SEQ ID NO: 1389 - DNA, 36 bp, Artificial; identical to SEQ ID NO: 1388
  synthetic oligonucleotide

SEQ ID NO: 1390 - DNA, 26 bp, Artificial
  synthetic oligonucleotide
  modified_base (6)..(6): c or methylated C nucleotide
  modified_base (10)..(10): c or methylated C nucleotide
  modified_base (15)..(15): c or methylated C nucleotide
  modified_base (20)..(20): c or methylated C nucleotide
  modified_base (24)..(24): c or methylated C nucleotide
  modified_base (26)..(26): c or methylated C nucleotide
ccacccgcccgctccgctgcgcccgc

SEQ ID NO: 1391 - DNA, 26 bp, Artificial
  synthetic oligonucleotide
ccacccgcccgctccgctgcgcccgc

SEQ ID NO: 1392 - DNA, 26 bp, Artificial
  synthetic oligonucleotide
  modified_base (9)..(9): c or methylated C nucleotide
  modified_base (13)..(13): c or methylated C nucleotide
  modified_base (18)..(18): c or methylated C nucleotide
  modified_base (23)..(23): c or methylated C nucleotide
cggccacccgcccgctccgctgcgcc

SEQ ID NO: 1393 - DNA, 26 bp, Artificial
  synthetic oligonucleotide
cggccacccgcccgctccgctgcgcc

SEQ ID NO: 1394 - DNA, 26 bp, Artificial
  synthetic oligonucleotide
  modified_base (12)..(12): c or methylated C nucleotide
  modified_base (16)..(16): c or methylated C nucleotide
  modified_base (21)..(21): c or methylated C nucleotide
  modified_base (26)..(26): c or methylated C nucleotide
ggccggccacccgcccgctccgctgc

SEQ ID NO: 1395 - DNA, 26 bp, Artificial
  synthetic oligonucleotide
ggccggccacccgcccgctccgctgc

SEQ ID NO: 1396 - DNA, 26 bp, Artificial
  synthetic oligonucleotide
  modified_base (15)..(15): c or methylated C nucleotide
  modified_base (19)..(19): c or methylated C nucleotide
  modified_base (24)..(24): c or methylated C nucleotide
ccgggccggccacccgcccgctccgc

SEQ ID NO: 1397 - DNA, 26 bp, Artificial
  synthetic oligonucleotide
ccgggccggccacccgcccgctccgc

SEQ ID NO: 1398 - DNA, 26 bp, Artificial
  synthetic oligonucleotide
  modified_base (18)..(18): c or methylated C nucleotide
  modified_base (22)..(22): c or methylated C nucleotide
cgtccgggccggccacccgcccgctc

SEQ ID NO: 1399 - DNA, 26 bp, Artificial
  synthetic oligonucleotide
cgtccgggccggccacccgcccgctc

SEQ ID NO: 1400 - DNA, 26 bp, Artificial
  synthetic oligonucleotide
  modified_base (4)..(4): c or methylated C nucleotide
  modified_base (9)..(9): c or methylated C nucleotide
  modified_base (14)..(14): c or methylated C nucleotide
  modified_base (18)..(18): c or methylated C nucleotide
  modified_base (20)..(20): c or methylated C nucleotide
gcccgctccgctgcgcccgcggggcc

SEQ ID NO: 1401 - DNA, 26 bp, Artificial
  synthetic oligonucleotide
gcccgctccgctgcgcccgcggggcc

SEQ ID NO: 1402 - DNA, 26 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (15)..(15): c or methylated C nucleotide
  modified_base (17)..(17): c or methylated C nucleotide
cgctccgctgcgcccgcggggcccgg

SEQ ID NO: 1403 - DNA, 26 bp, Artificial
  synthetic oligonucleotide
cgctccgctgcgcccgcggggcccgg

SEQ ID NO: 1404 - DNA, 26 bp, Artificial
  synthetic oligonucleotide
  modified_base (3)..(3): c or methylated C nucleotide
  modified_base (8)..(8): c or methylated C nucleotide
  modified_base (12)..(12): c or methylated C nucleotide
  modified_base (14)..(14): c or methylated C nucleotide
tccgctgcgcccgcggggcccggcca

SEQ ID NO: 1405 - DNA, 26 bp, Artificial
  synthetic oligonucleotide
tccgctgcgcccgcggggcccggcca

SEQ ID NO: 1406 - DNA, 26 bp, Artificial
  synthetic oligonucleotide
  modified_base (5)..(5): c or methylated C nucleotide
  modified_base (9)..(9): c or methylated C nucleotide
  modified_base (11)..(11): c or methylated C nucleotide
gctgcgcccgcggggcccggccagtg

SEQ ID NO: 1407 - DNA, 26 bp, Artificial
  synthetic oligonucleotide
gctgcgcccgcggggcccggccagtg

SEQ ID NO: 1408 - DNA, 26 bp, Artificial
  synthetic oligonucleotide
  modified_base (2)..(2): c or methylated C nucleotide
  modified_base (8)..(8): c or methylated C nucleotide
gcgcccgcggggcccggccagtgggt

SEQ ID NO: 1409 - DNA, 26 bp, Artificial
  synthetic oligonucleotide
gcgcccgcggggcccggccagtgggt

SEQ ID NO: 1410 - DNA, 24 bp, Artificial
  synthetic oligonucleotide
  modified_base (1)..(1): c or methylated C nucleotide
  modified_base (5)..(5): c or methylated C nucleotide
  modified_base (10)..(10): c or methylated C nucleotide
  modified_base (15)..(15): c or methylated C nucleotide
  modified_base (19)..(19): c or methylated C nucleotide
  modified_base (21)..(21): c or methylated C nucleotide
cgcccgctccgctgcgcccgcggg

SEQ ID NO: 1411 - DNA, 24 bp, Artificial
  synthetic oligonucleotide
cgcccgctccgctgcgcccgcggg

SEQ ID NO: 1412 - DNA, 22 bp, Artificial
  synthetic oligonucleotide
  modified_base (3)..(3): c or methylated C nucleotide
  modified_base (8)..(8): c or methylated C nucleotide
  modified_base (13)..(13): c or methylated C nucleotide
  modified_base (17)..(17): c or methylated C nucleotide
  modified_base (19)..(19): c or methylated C nucleotide
cccgctccgctgcgcccgcggg

SEQ ID NO: 1413 - DNA, 22 bp, Artificial
  synthetic oligonucleotide
cccgctccgctgcgcccgcggg

SEQ ID NO: 1414 - DNA, 20 bp, Artificial
  synthetic oligonucleotide
  modified_base (1)..(1): c or methylated C nucleotide
  modified_base (6)..(6): c or methylated C nucleotide
  modified_base (11)..(11): c or methylated C nucleotide
  modified_base (15)..(15): c or methylated C nucleotide
  modified_base (17)..(17): c or methylated C nucleotide
cgctccgctgcgcccgcggg

SEQ ID NO: 1415 - DNA, 20 bp, Artificial
  synthetic oligonucleotide
cgctccgctgcgcccgcggg

SEQ ID NO: 1416 - DNA, 18 bp, Artificial
  synthetic oligonucleotide
  modified_base (4)..(4): c or methylated C nucleotide
  modified_base (9)..(9): c or methylated C nucleotide
  modified_base (13)..(13): c or methylated C nucleotide
  modified_base (15)..(15): c or methylated C nucleotide
ctccgctgcgcccgcggg

SEQ ID NO: 1417 - DNA, 18 bp, Artificial
  synthetic oligonucleotide
ctccgctgcgcccgcggg

SEQ ID NO: 1418 - DNA, 16 bp, Artificial
  synthetic oligonucleotide
  modified_base (2)..(2): c or methylated C nucleotide
  modified_base (7)..(7): c or methylated C nucleotide
  modified_base (11)..(11): c or methylated C nucleotide
  modified_base (13)..(13): c or methylated C nucleotide
ccgctgcgcccgcggg

SEQ ID NO: 1419 - DNA, 16 bp, Artificial
  synthetic oligonucleotide
ccgctgcgcccgcggg

SEQ ID NO: 1420 - DNA, 15 bp, Artificial
  synthetic oligonucleotide
  modified_base (1)..(1): c or methylated C nucleotide
  modified_base (6)..(6): c or methylated C nucleotide
  modified_base (10)..(10): c or methylated C nucleotide
  modified_base (12)..(12): c or methylated C nucleotide
cgctgcgcccgcggg

SEQ ID NO: 1421 - DNA, 15 bp, Artificial
  synthetic oligonucleotide
cgctgcgcccgcggg

SEQ ID NO: 1422 - DNA, 24 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcgcccgcg

SEQ ID NO: 1423 - DNA, 24 bp, Artificial
  synthetic oligonucleotide
cccgcccgctccgctgcgcccgcg

SEQ ID NO: 1424 - DNA, 22 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
cccgcccgctccgctgcgcccg

SEQ ID NO: 1425 - DNA, 22 bp, Artificial
  synthetic oligonucleotide
cccgcccgctccgctgcgcccg

SEQ ID NO: 1426 - DNA, 20 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
cccgcccgctccgctgcgcc

SEQ ID NO: 1427 - DNA, 20 bp, Artificial
  synthetic oligonucleotide
cccgcccgctccgctgcgcc

SEQ ID NO: 1428 - DNA, 18 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
cccgcccgctccgctgcg

SEQ ID NO: 1429 - DNA, 18 bp, Artificial
  synthetic oligonucleotide
cccgcccgctccgctgcg

SEQ ID NO: 1430 - DNA, 16 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
cccgcccgctccgctg

SEQ ID NO: 1431 - DNA, 16 bp, Artificial
  synthetic oligonucleotide
cccgcccgctccgctg

SEQ ID NO: 1432 - DNA, 15 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
cccgcccgctccgct

SEQ ID NO: 1433 - DNA, 15 bp, Artificial
  synthetic oligonucleotide
cccgcccgctccgct

SEQ ID NO: 1434 - DNA, 21 bp, Artificial
  synthetic oligonucleotide
  modified_base (12)..(12): c or methylated C nucleotide
  modified_base (14)..(14): c or methylated C nucleotide
  modified_base (16)..(16): c or methylated C nucleotide
ggggcacatggcgcgcggggc

SEQ ID NO: 1435 - DNA, 21 bp, Artificial
  synthetic oligonucleotide
  misc_feature (1)..(21): BL7-3 59138557-59138577 (Location on chromosome 18)
ggggcacatggcgcgcggggc

SEQ ID NO: 1436 - DNA, 21 bp, Artificial
  synthetic oligonucleotide
  modified_base (15)..(15): c or methylated C nucleotide
  modified_base (17)..(17): c or methylated C nucleotide
  modified_base (19)..(19): c or methylated C nucleotide
ccgggggcacatggcgcgcgg

SEQ ID NO: 1437 - DNA, 21 bp, Artificial
  synthetic oligonucleotide
  misc_feature (1)..(21): BL7-4 59138554-59138574 (Location on chromosome 18)
ccgggggcacatggcgcgcgg

SEQ ID NO: 1438 - DNA, 27 bp, Artificial
  synthetic oligonucleotide
  modified_base (16)..(16): c or methylated C nucleotide
  modified_base (18)..(18): c or methylated C nucleotide
  modified_base (20)..(20): c or methylated C nucleotide
  modified_base (26)..(26): c or methylated C nucleotide
gccgggggcacatggcgcgcggggccg

SEQ ID NO: 1439 - DNA, 27 bp, Artificial
  synthetic oligonucleotide
gccgggggcacatggcgcgcggggccg

SEQ ID NO: 1440 - DNA, 27 bp, Artificial
  synthetic oligonucleotide
  modified_base (19)..(19): c or methylated C nucleotide
  modified_base (21)..(21): c or methylated C nucleotide
  modified_base (23)..(23): c or methylated C nucleotide
cccgccgggggcacatggcgcgcgggg

SEQ ID NO: 1441 - DNA, 27 bp, Artificial
  synthetic oligonucleotide
cccgccgggggcacatggcgcgcgggg

SEQ ID NO: 1442 - DNA, 27 bp, Artificial
  synthetic oligonucleotide
  modified_base (22)..(22): c or methylated C nucleotide
  modified_base (24)..(24): c or methylated C nucleotide
  modified_base (26)..(26): c or methylated C nucleotide
cgtcccgccgggggcacatggcgcgcg

SEQ ID NO: 1443 - DNA, 27 bp, Artificial
  synthetic oligonucleotide
cgtcccgccgggggcacatggcgcgcg

SEQ ID NO: 1444 - DNA, 17 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
acatggcgcgcggggcc

SEQ ID NO: 1445 - DNA, 17 bp, Artificial
  synthetic oligonucleotide
acatggcgcgcggggcc

SEQ ID NO: 1446 - DNA, 15 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
acatggcgcgcgggg

SEQ ID NO: 1447 - DNA, 15 bp, Artificial
  synthetic oligonucleotide
acatggcgcgcgggg

SEQ ID NO: 1448 - DNA, 24 bp, Artificial
  synthetic oligonucleotide
  misc_feature (1)..(24): n= a c g or t
nnnnnnnnnnnnnnnnnnnnnnnn

SEQ ID NO: 1449 - DNA, 24 bp, Artificial
  synthetic oligonucleotide
cacgcacgcgcatccccgccagtg

SEQ ID NO: 1450 - DNA, 27 bp, Artificial
  synthetic oligonucleotide
  modified_base (7)..(7): c or methylated C nucleotide
  modified_base (9)..(9): c or methylated C nucleotide
  modified_base (11)..(11): c or methylated C nucleotide
  modified_base (17)..(17): c or methylated C nucleotide
  modified_base (22)..(22): c or methylated C nucleotide
acatggcgcgcggggccgggccgggga

SEQ ID NO: 1451 - DNA, 27 bp, Artificial
  synthetic oligonucleotide
acatggcgcgcggggccgggccgggga

SEQ ID NO: 1452 - DNA, 21 bp, Artificial
  synthetic oligonucleotide
  modified_base (3)..(3): c or methylated C nucleotide
  modified_base (5)..(5): c or methylated C nucleotide
  modified_base (7)..(7): c or methylated C nucleotide
  modified_base (13)..(13): c or methylated C nucleotide
  modified_base (18)..(18): c or methylated C nucleotide
ggcgcgcggggccgggccggg

SEQ ID NO: 1453 - DNA, 21 bp, Artificial
  synthetic oligonucleotide
ggcgcgcggggccgggccggg

SEQ ID NO: 1454 - DNA, 32 bp, Artificial
  synthetic oligonucleotide
gcgccgccaaccgcctggaccctttctggccg

SEQ ID NO: 1455 - DNA, 34 bp, Artificial
  synthetic oligonucleotide
cgcacgacggagtgcggaggggggcggctggcgg

SEQ ID NO: 1456 - DNA, 42 bp, Artificial
  synthetic oligonucleotide
cggccagtgggtggcgcgggcggcacaggcctccccgcgggc

SEQ ID NO: 1457 - DNA, 35 bp, Artificial
  synthetic oligonucleotide
gcgccgcggcaggcccgggagtggccgtcccgccg

SEQ ID NO: 1458 - DNA, 32 bp, Artificial
  synthetic oligonucleotide
cagggaaaggggtttatcaagggctttacgac

SEQ ID NO: 1459 - DNA, 29 bp, Artificial
  synthetic oligonucleotide
cacctgaacacctagtccgtgcccaggcc

SEQ ID NO: 1460 - DNA, 36 bp, Artificial
  synthetic oligonucleotide
cgccccccaccgcccccagcagtgagacctcagcgc

SEQ ID NO: 1461 - DNA, 36 bp, Artificial
  synthetic oligonucleotide
accccgaccgccccctccgccccgctccctggcccg

SEQ ID NO: 1462 - DNA, 21 bp, Artificial
  synthetic oligonucleotide
  modified_base (6)..(6): c or methylated C nucleotide
  modified_base (8)..(8): c or methylated C nucleotide
  modified_base (10)..(10): c or methylated C nucleotide
  modified_base (16)..(16): c or methylated C nucleotide
  modified_base (21)..(21): c or methylated C nucleotide
catggcgcgcggggccgggcc

SEQ ID NO: 1463 - DNA, 21 bp, Artificial
  synthetic oligonucleotide
catggcgcgcggggccgggcc

SEQ ID NO: 1464 - DNA, 21 bp, Artificial
  synthetic oligonucleotide
  modified_base (9)..(9): c or methylated C nucleotide
  modified_base (11)..(11): c or methylated C nucleotide
  modified_base (13)..(13): c or methylated C nucleotide
  modified_base (19)..(19): c or methylated C nucleotide
gcacatggcgcgcggggccgg

SEQ ID NO: 1465 - DNA, 21 bp, Artificial
  synthetic oligonucleotide
gcacatggcgcgcggggccgg

SEQ ID NO: 1466 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgtatccccgcccgtg

SEQ ID NO: 1467 - DNA, 24 bp, Artificial
  synthetic oligonucleotide
cacgcacgcgtatccccgcccgtg

SEQ ID NO: 1468 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcgcgcgcatccccgcccgtg

SEQ ID NO: 1469 - DNA, 24 bp, Artificial
  synthetic oligonucleotide
cacgcgcgcgcatccccgcccgtg

SEQ ID NO: 1470 - DNA, 24 bp, Artificial
  synthetic oligonucleotide
  modified_base (3)..(3): c or methylated C nucleotide
  modified_base (7)..(7): c or methylated C nucleotide
  modified_base (9)..(9): c or methylated C nucleotide
  modified_base (17)..(17): c or methylated C nucleotide
  modified_base (21)..(21): c or methylated C nucleotide
cacgcacgcgcatccccgaccgtg

SEQ ID NO: 1471 - DNA, 24 bp, Artificial
  synthetic oligonucleotide
cacgcacgcgcatccccgaccgtg

SEQ ID NO: 1472 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgccccgctgcgcccgcggg

SEQ ID NO: 1473 - DNA, 26 bp, Artificial
  synthetic oligonucleotide
cccgcccgccccgctgcgcccgcggg

SEQ ID NO: 1474 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgtccgctccgctgcgcccgcggg

SEQ ID NO: 1475 - DNA, 26 bp, Artificial
  synthetic oligonucleotide
cccgtccgctccgctgcgcccgcggg

SEQ ID NO: 1476 - DNA, 26 bp, Artificial
  synthetic oligonucleotide
  modified_base (3)..(3): c or methylated C nucleotide
  modified_base (7)..(7): c or methylated C nucleotide
  modified_base (12)..(12): c or methylated C nucleotide
  modified_base (17)..(17): c or methylated C nucleotide
  modified_base (21)..(21): c or methylated C nucleotide
  modified_base (23)..(23): c or methylated C nucleotide
cccgcccgctccgctgcggccgcggg

SEQ ID NO: 1477 - DNA, 26 bp, Artificial
  synthetic oligonucleotide
cccgcccgctccgctgcggccgcggg

SEQ ID NO: 1478 - DNA, 150 bp, Artificial
  synthetic oligonucleotide
  misc_feature (1)..(150): TGF-alpha promoter region
atttgccaagcagactctgaccttttccctcttctcctccacccaacaggtattgtgttggctgcgtgccaggccttggagaacagcacgtccccgctgagtggtgagtgcagctgccgtgggtgtgtggatcgtgtgtgggaagggagc

SEQ ID NO: 1479 - DNA, 200 bp, Artificial
  synthetic oligonucleotide
  misc_feature (1)..(200)
  misc_feature (1)..(200): TGF-alpha promoter region
ctggtagggtgggaggtgtggggtttgcatgtcagctgttcctggatctgagccctgcatctttcctctccccagcagacccgcccgtggctgcagcagtggtgtcccattttaatgactgcccagattcccacactcagttctgcttccatggaacctgcaggtttttggtgcaggaggacaagccagcatgtgtgtaa

What is claimed is:

1. A composition comprising an amphoteric liposome comprising
   (i) a DNAi oligonucleotide comprising SEQ ID NOs: 1250 or 1251 or the complements thereof;
   (ii) a mixture of lipid components comprising POPC, DOPE, MoChol, and CHEMS in a molar ratio of POPC/DOPE/MoChol and CHEMS of about 6/24/47/23.

2. The composition of claim 1, wherein the molar ratio of POPC/DOPE/MoChol/CHEMS is 6/24/47/23.

3. The composition of claim 1, wherein the amphoteric liposomes comprise a size between about 50 and 500 nm.

4. The composition of claim 1, wherein the amphoteric liposome comprises a size between about 80 and 200 nm.

5. The composition of claim 1, wherein the amphoteric liposome has a DNAi oligonucleotide concentration of at least 2 mg/ml at a lipid concentration of about 100 mM or less.

6. The composition of claim 1, wherein the DNAi oligonucleotide comprises SEQ ID NOs: 1250 or 1251.

7. The composition of claim 1, wherein the DNAi oligonucleotide comprises SEQ ID NO: 1251.

8. A method comprising
   (a) providing the composition of claim 1, and
   (b) introducing the composition into a cell or animal capable of expressing the bcl-2 gene.

9. The method of claim 8, wherein introducing the composition results in a reduction of proliferation of the cell, or induces cell death.

10. The method of claim 8, wherein the cell is a cancer cell.

11. The method of claim 8, wherein the animal is a human.

12. The method of claim 8, wherein the composition is introduced to the animal by one or more routes of administration selected from topical, pulmonary, intraocular, intranasal, parenteral, and a medical device.

13. The method of claim 8, wherein the cell is in cell culture.

14. The method of claim 8, further comprising the step of introducing a chemotherapy agent to the cell or animal.

15. The method of claim 8, wherein said animal has a cancer which is selected from pancreatic cancer, colon cancer, breast cancer, bladder cancer, lung cancer, leukemia, prostate cancer, lymphoma, ovarian cancer and melanoma.

16. A pharmaceutical composition comprising an amphoteric liposome and a DNAi oligonucleotide comprising SEQ ID NOs:1251 or 1250 wherein the liposome comprises POPC, DOPE, MoChol and CHEMS in the molar ratio of POPC/DOPE/MoChol/CHEMS of 6/24/47/23.

* * * * *